United States Patent 7,368,527 (HADDE71 POLYPEPTIDES) - sequence listing, part 9

SEQ ID NO: 12838 - DNA, 5064 bp, Homo sapiens
tcttttgcttttacattttattattattatactttaagttttagggtacatgtgcacaacgtgcaggtttgttacatatgtatacatgtaccatgttggtgtgctgtacccattaactcgtcatttagcattaggtatatctcttaatgctatccctccaccctcccctgaccccacaacagtcccgggtgtgtgatgttccccttcctgtgtccatgtgttctcattgttcatttcctacctatgagtgagaacatgcagtgtttggttttttgtccttgcaatagtttgctgagaatgatggtttccagtttcatccatgtccctacaaaggacatgaactcatcattttttatggctgcatagtattccatggtgtatatgtgccacattttcttaatccagtctatcgttgttggacatttaggttggttccaagtctttgctgttgtgaatagtgccactataaacatacgtgtgcatgtgtctttacagcagcatgatttataatcctttgggtatatacccagtaatgggatggctgggtcaaatggtatttctagttctagatccctgaggaattgccacactgacttccacaatggttgaactagtttacactcccaccaacagtgtaaaagtgttcgtatttctccacatcctctccagcacgtgttgtttcctgactttttaatgatcgccattctaactggtgtgagatggtatctcattgtggttttgatttgcatttccctgatggccagtgatgatgagcattttttatgtgttttttggctatgtaaatgtcttcttttgagaagtgtctgttcatatccttcgcccactttttgatggggttgtttgtttttttcttgtaaatttgtttgagttcgttgtagattctggatattagccctttgtcagatgagtaggttgcaaaaattttctcccatcctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatcattttaggtctaacatttaagtctctaatccatcttgaattaatttttgtataaggtgtaaggaagggatccagtttcagctttctacatatggctagccagttttcccagcaccatttattaaatagggaatcctttccccattgcttgtttttgtcacgtttgtcaaagatcagatagttgtagatatgcggcgttatttctgagggctctgttctgctccattggtctatatctctgttttggtaccagtaccatgctgttttggttactgtagccttgtagtatagtttgaagtcaggtagtgtgatgcctccagctttgttctttgggcttaggattgactcggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccacgagtatggaacgttcttccatttgtttgtatcctcttttatttcattgagcagtggtttgtagttctccttgaagaggtccttcacatctcttgtaagttggattcctaggtattttattctctttgaagcaattgtgaatgggagttcactcatgatttggctctctgtttgtctgtcattggtgtataagaatgcttgtgatttttgtacattgattttgtatcctgagactttgctgaagttgcttatcagcttgaggagattttgggctgagatgatggggttttctaaatatacaatcatgtcatctgcaaacagggacaatttgacttctttttttcctaattgaatgccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtgtttagcatgaagggttgttgaattttgtcaaaggccttttctgcatctattgagataatcatgtggtttttgtctttagttctgtttataccttggattacatttattgatttgcgtatgttgaactggctttgcatcccagggatgaagcccacttgatcatggcggataagctttttgatgtgctgctggattcggtttgccagtattttactgaggatttttgcatcgatgttcatcaaggatattggctaaaattctctttttttgttgtgtctctgccaggctttggtatcaggatgatgctggcctcataaaatgagttagggaggattccctctttttctgttgattggaatagtttcagaaggaatggtaccatttcctccttgtacctctggtacaattcggctgtgaatccgtctggtcctggactctttttggttggtaagctattgattattgcctcaatttcagatcctgttattggtctattcagagattcagcttcttcctggtttagtcttgggaggatgtatgtgtcgaggaatttatccatttcttctagattttctagttgatttgcatagaggtgtttatagtattctctgatggtagtttgtatttctgtgggatcggtggtgatctcccctttatcatttttgattgcgtctatttgattcttctctcttttcttctttattagtcttgctagcagtctatcaattttgttgatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgtaagggtgtcaattttagatctttcctgctttctcttgtgggcatttagtgctatacatttccctctacacactgctttgaatgtgtcccagagattctggtatgttgtctttgttctcgttggtttcaaagaacatctttatttctgccttcatttcattatttacccagtagtcattcgggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtcctcttgttgcagagctgagttcaattcctgggtatccttgttaactttctgtctcgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttgttgttgaattgatccctttaccattatgtaatggccttctttgtctcttttgatctttgttggtttaaagtctgttttatcagagactaggattgcaatccctgccttcttttggtttccatttgcttggtagatcttcctccatccctttattttgagcctatgtgtgtctctgcacgtgagatgggtttcctgaatacagcacactgatgagtcttgactctttatccaatctgccagtctgtgtcttttaattggagcatttagcccatttacgtttaaagttaatattgttatgtgtgaatttgatcctgtcattatgatgttagctggttattttgctcgttagttggtgcagtttcttcctagccttgatggtctttacaatttggcatgtttttgcagtggctggtactggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatcagcttttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatactgcagagtgttttccaacttggttccattctccccgtcactttcaggtataccaatcagacgtagatttggccttttcacatagtcccatatttcttggaggctttgttcgtttctttttattcttttttctctaaacttctcttctcgcttcatttcattcatttcgtcttccatcactgataccctttcttccagttgatcgcatcggctcctgaggcttctgcattcgtcacgtagctctcgtgccttggttttcagctccatcaggtcctttaaggacttgtctgcattgattattcttgttatccattcatcttattttttttcaaagcttttaacttctttgccattgattcgaatttcctcctgtagctcagagtagtctgatcatctgaggccttctttcaactcgtcagagtcattctccatccagctttgttccgttgctggtgaggagctgcgtt

SEQ ID NO: 12839 - DNA, 14411 bp, Homo sapiens
ttttcttttttttttttttaaattttttttttttattatactctaagttttagggtacatgtgcacattgtgcaggttagttacatatgtatacatgtgccatgctggtgcgctgcacccactaactcatcatctagccttaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccacgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatcgtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtatctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgctgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatacatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcactctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgctggggggtgcctcccagttaggctgcttgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgttgccaccttgcagtttgatctcagactgctgtgctagcaatcagctcgattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacagtgcgcacacacactggcctgcgcccactgtctggcactccctagtgagatgaacctggtacctcagatggaaatgcagaaatcacccgtcttctgcgtcgctcacgctgggagctgtagaccggagctgttcctatttggccatcttggctcctccccgcatagcagctttatttgtgatagctattgtcagttttgaaccccagctgaggcccaaggggaatgggtggacggggggcagggagctggaagaatactcaagagacagcaggtagatgggacatggcttcattcagccccactctcacagtatcagtgctgcatttatatgcctcacagacaacagtggctcagagccaggtgatgagctttcttatcttatggctacatagctgtgattatataatgtatgaaattgtgcgcctgtgctccaatcctgctgagtcatgcaggatgtttgcctctgcctatgcctgcctggctgcagcacagccatgttccttacagccatgtattcacttatctaaaattcacaaccatcctataagtaagtaccctccatatccttattttccagaatattgttaggaagtggggaagtgttgcgttagccacttaacacttgttcgccaactgggctaataacagcacctgcttcaaaataggttgggaacttcaaattgaataatacatatagagtacccagtccagtgcttagcacattgtgtattctcaataatataattgatgatgatgctgaaaatgattattttatagcagggcaatgatagtccaaatccatgtagtcagatgctagaattaagaggatctaagatatatgggattctttgccatattttactatatatcttagagaagttaaaaataaagagcttgttttgtaaggaaacagtaacaaattttaataaaatactattgaattctggaggcaggcaggaaggtatgcagatttcattcctttaggaaacaggcaaatctactgaattaggaccaaactgtctgcatcagggcctccagatgagaagcctctagttcctcacacctttacagttgtatgagcagaggtggtcagggtataacattagaagatctgttttctgaagacatatttccttgtgtcagaagggcaggcccacagtgcaacactctttagtggcctgggagaagcaggtaactacttatctggataggcaggactgttaactcttcacttaaggtattttccttccagccatcaagacattttttattgttgtcatttgactacacaagtaatttgtgatcttccaaggaaaacagaaaaatgtgatcaaacaagatgagagtatagaagccttacgaccccacctatctattaatgccttcatggatatctttccagaactttttctaagcagttttaaaaagaaacaaaaatgggataatggcacacatacatattgtttgtaaattgatttttttcacctgacaatagattctgaattttttttcatttcagttgatgcatttctgtaacatcgttaatctttgtataggtatatcatcatctatttaactaatcccctaattgtggacatttccaattatttgatattctaacagggcttttctgaccatttttaatcctaccatatgattcaacaaattatcatgactgataattttcttagtggaaactgtctaaaagagaaattgcctagtgaaagggtaggaacattttaaagattttttgatgcatttccaatttcccatcaatgaaggtgtgcaactctcactgtcagtgcacataatgttactttaagataaactccataagggagagagtgtaataaattcatgtattactagtgtatacctttttatctgtaagcagtcaaatagtatgcaaatggggtcactttgtacatctaaattgggattagggtaggcagctcagggtaatcaggtcaaggcagatggatttatcccaagctgaggagcatgaaacattaaccaaaagataaaaatagaagaaatagaagtgaaaagcctactcaaggaaagatgaagcaatcaatagtgtatttttttgctgttgatcttgtaaaattgctcctatctatctatctatctatctatctatctatctatctacctatctgttgatcaagatggtgtcctgctatgttgtccaggctagaatcaaactcctgggctcaagggagcctactgtttccacctctcaagtagctgggactacaggtgctcactactgtgcccagcgatatatgtatcagagtatgttacacaggcaggaatgcagtggcgtgatctcagttcactgcaacctctgcctcccaggttcaagcgatcctcttgcctcaaccccccaagtagctgggattacaggcatgcgccaccatgcccggctaatttttgcatttttgatagagatggggtttcgccatgttggccaggttggtcttgaactcctgacctcaggtgatccaactgctttggcctcccaaagtgctgggattacaggcatatatagttctaaaagaacaaagggggattccattccaagatggcccaataggaacagctccggtctgcagctcccagtgtgattgatgcagaagacggtgatttctgcatttctaattgaagtacctggttcatctcactgggactggctggacagtgggtgcagcccacagagggtgggctgaagcagggtggggcatcgccttacccggaaagcacaaggggtcaggggatttccctttcctagccaagggaagccatgacagactgtacctggaaaatcaggacacttccgcccaaatactgcgcttttccaatggtcttagcaaatggcacaccagaagattatatcccacgcctggttcggtgggtcctatgcccatggagccttgctcactgctagagcagcagtctgagattgacctgcaaggcagcagtctggcagggggagtggtgtccaccattgctgaggcttgagtaggtaaacaaagcaactggggaatctcaaactgggcggagcccatcgcagctgtgcaaggcctgctgcttctgtagaccccacctctgggggcagggcatagctgaacaaaaggcagcagaaacttttgcagacttaaacatccctgtctgatagctctgaagagagcagtggttctcccagcatggtgtttgagctctaagaatagacagactgcctcctgaagtgggtccctgacccccatgtagcctaactgggagatacctcccaataggggccgactgacacctcacacagacaggtgcccctctgggacgaagcttccagaggaaggatcaggcagcaatatttgctgttctgcaatatttgctgtcctgcagcctccgctggtgatacccaggaaacagggtctggagtggacctccagcaaactccaacagaactgcagctaagggacctgattgttaaaaggaaaactaaaaaacagaaaggaatagcatcaacatcaacataaaggacatgcacaccaaaaccccatctgtaggtcaccagcatcaaaaccaaaggtagatagaaccacaaagatggggagaaaccagagcagaaaagctgaaaattctaaaaaccagagcacctcttctcctccaaaggatcacagctcctcaccagcaaaggaacaaagctggatggagaatcactttgatgagctgacaaaagtagtcttcggaaagttggtaataacaaacttctccaagctaaaggaggatgtttgaacccattgcaaagaagctaaaaaccttgaaaaaagattagacaaatggctgactagaataaacagtgtagagaagaccttaagtgacctgatggagctgaaaaccatggcatgagaactacatgacacatgcacaagcttcaatagctgatttgatcaagtggaagaaagagtatcagtgattgaagatcaaattagtgaaataaggtgagaagagaagtttagagaaaaaaacagtaaaaagaaacaaacaaagcctccaagaaatatgggactatgtgaaaagatcaaatctacatttgattggtgtacctgaaagtgacggggagaatggaaccaaattggaaaacacttttcaggatattatccaggagaacttccccaacctagcaaggcagaccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagcccatcagactaacagcggatctctcggcagaaactctacaagccagaagagagtgggggccaatattccattcttaaagaaaagaattttcaacccagaatttcatatccagccaaactaagcttcataagtgaaggagaaataaaatcctttacagacaagcaaatgctgagagattttgtcaccaccaggcctaccttacaagagctcctgaaggaagcactaaacatgggaaggaacaaccagtaccagtcactgcaaaaacatgctaaattgtaaagaccatcgatgctaggaagaaactacatcaactaacgggcaaaataaccagctaacatcagaatgacaggatcaaattcacacataacaatattaaccttaaatgtaaatgggctaaatgccccaattaaaagacccagactggcaaattggataaagagtcaagacccatcagtgtgctgtattcatgagacccatctcatgtgcagagagacacataggctcaaaataaagagatggaggaagatctaccaagcaaatggaaagcaaaaaaaaaaaaaaaaaaaaaagcaggggttgcaatcctagtctcttataaaacacactttaaaccaacaaagatcaaaagagacaaagaaggtcattacataatggtaaagggatcaattcaacaagaagaactaactatcctaaatatatatgcacccaatacaggagcacccagattcataaagcaaatccttagagacctacaaagagacttagactcccacacaataataatgggagattttaacaccccactgtcaatattagacagatcaacgagacagaagtttaacaagggtgtccaggacttgaactcagctctgcaccaaacggacctaatagacatctacagaactctccaccccaaatcaacagaatatacattcttctcagcaccacattgcacttattccaaaatagttgcaagtaaagcactcctcagaaaatgtaaatgaacagaaatcacaacaaactgtctctcagaccacagtgcaatcaaattagaactcaggattaagaaactcactcaaaactgcaaaactacatggaaactgaacaacctgctcctgaatgactactgcgtaaataatgaaatgaaggcagaaataaagatgttctttgaaaccaatgagaacaaagacacaatgtaccagagtctctgggacacatttaaagcagtgtgtagagggaaatttatagcaccaaatgcccacaagagaaaccaggaaagatctaaaatcgacaccctaacatcacaattaaaagaactagagaagcaagagcaaacaaattcaaaagctagcagaagacaagaaataactaatatcagagcagaactgaaggagatagagacacaaaaaacccttcaaaaaatcaatgaatccaggagctggttttttgaaaggagtgacaaaattgatcgaccattagcaagactaataaagaagaaaagagagaagactcaagtagatgcaataaaaaatgataaaggggatatcaccactgatcctacagaaatacaaactaccatcagagaatactacaaacacctctatgcaaataaactagaaaatctagaagaaatggataaattcatggacacatacccccttccaagactaaaccaggaagaagttgaatctctgaatagaccaataacaggatctgaaattgaggcaataattaatagcctaccaaccaaaaaaagtccaggaccagatggattcacagctgaattttaccagaggtacaaagagaagctggtgtcattccttctgaaactattccaatcaatagaaaaagagtgaatcctccctaaatcattttatgagaccagcaacatcctgataccaaagcctggcagagacacactaaaaaaagagaatttaagaccaatatctctaatatgatgaacatagatgcaaaaatcctcaataaaatactggcaaatcgaatccagcagcacatcaaaaagcttatccaccacgatcaagttggcttcatccctgggatgcaaggctggttcaacatatgcaaatcaatagacgtaatccatcacataaacagaaccaacgaaaaaaaacacacgattatctcagtagatgtagaaaaggcctcggcaaaattcaacagccttcatgctaaaaactctctataaactagatattgatggaatgtatctcaaaataataacagctatttatgacaaacccacagccaatatcatactgaatgggaaaaactggaagcattccctttgaaaactggcacaagacagggatgccctctctcaccactcctattcaacatagtgttggaagttctggccagggcaatcaggcaaaagaaaggaataaagtgtattcaattaggaaaagagggagtcaaattgtccgtctttgcagatgacatgattgtatatttagaaaaccccatcatctcagcccaaaatctcctcaagctgataagcaacttcagcaaaatctcaggatacaaaatcaatgtgcaaaaatcacaaccattcctatacaccaataacagacagacagagagccaaatcatgagtgaactcccattcacaattgcttcaaagagaataaaatacctaggaatccaccaagggatgtgaaggacctcttcaaggacagctacaaaccactgctcaacaaaataaaagaggacacaaacaaatggaagaacattccatgctcatggatataaagaatcaatatcgtgaaaatggccatattgcccaaggtaatttatagattcaatgccatccccatcaagctaccaatgactttcttcacaggattggaaaaaactactttaaagttcgtatggaaccaaaaaagagcccgcattgccaagacaatcctaagcaaaaagaacaaagctggaggcatcatgctacctgacttcaaactatactacaaggatacagtaaccaaaacagcatggtactggtaccaaaacagagagatagaccaatgcaacagaacagaggtctaagcaataacaccacacatctacaaccatctgatctttgacaaacctgacaaaaacaagaaatggggaaaggataccctatttaataaattgtgctgggaaaactgggtagccatatgtagaaagctgaaactggatcccttccttacacattatacaaaaattaattcaagatggattgaagacttaaatgttcgatctacaaccataaaaaccctagaagaaaacctaggcaataccattcaggacacaggcatgggaaaggacttcatgactaaaacaccaaaagcagtggcaacaaaagccaaaattgacaaatgggatctcattaaactaaagagcttctgcacagcaaaagaaactaccatcagagtgaacaggcaacctacagaatggtagaaaaattttgcaatctacccatctgacaaagggctaatatccagaatctacaaagaagttaatcaaatttacaagaaaaaaacaaccccatcaaaaagtgggcaaaggatatgaacagacacttctcaaaagaagacatttatgcagccaacagacacatgaaaaaatgctcatcgtcactggtcatcagataaatgcaaatcaaaaccacaatgagataccatctcacaccagttagaatggcgatcattaaaaagtcaggaaacaacagatgctggagaggatgtggagaaataggaatgcttttacactgttgttgggagtgtaaactagttcaaccattgtggaagacagtgtggtgattcctgaaggatctggaactagaaataccagttgacccagcaatcccattactgggtatacacccaaaggattataaatcatgctactataaagacacatgcacacgtatgtttattgcggcactattcacaatagcaaaaacttggaacaaacccaaatgtccatcaatgataggctggattaagaaaatgtggcacatatacaccatggaatactatgcagccataaaaaaggatgagtaaatgtcctttgtagtgacgtggatgaaggtggaaaccatcattctgatcaaaccatcacaaggacagaaaaccaatcaccgcatatcctcactcataggtggc

SEQ ID NO: 12840 - DNA, 8115 bp, Homo sapiens
  misc_feature (3295)..(3295): n equals a,t,g, or c
tttttttttattatactttaagtttaaggatacatgcgcccaacgtgcaggtttgttacatatgtatacatgtgccacgttggtgtgctgcacccaataacttgtcatttaacattaggtatatctcctaatgctatccctccccaccaacccacaacaggccctggtgtgtgatattccccttcctgtgtccatgtgttctcattgttcaattcccacctatgagtaagaacatgtggtgtttggttttttgtccttgcgatagtttgctgagaatgatggtttccagcttcatccatgtccctacaaaggacatgaactcatcattttttatggctgcatagtagtccatggtgtatatgtgccacattttcttaatccagtctatcatttttggacatttgggttggttccaagtctctgctattgtgaatagtgccacaataaacatatgtgtgcgtgtctctttatagcagcatgatttataatcctttgggtacatacccagtaatgggattgctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatctccattctaactggtgtgagatggtatctcattgtggttttgatttgcatttctctgatggtcagtgatgatgagcattttttcatgtgtcttttggctgcataaatgtcttcttttgagaagtgtctgttcatatccttcgctcactttttgatggggttgtttgtttttttcttgtaaatgtctttcagtttattgtagattctggatattagccctttgtcagatgagtagattgcaaaacttttctcccattctgtaggttgcctgttcattctgatggtagtttcttttgctgtgcagaagctctttagtttaattagatcctatttgtcaattttggcttttgttaccattgcttttggtgttttagacatgaagttcttgcccatgcctgtgtcctgaatggtattgcctaggttttcttctagggtttttatggttttaggtctaaaatttaagtctttaattcatcttgaattaatttttgtataaggtttaaggaagggatccagtttcagctttctccatatggctagtcagttttcccagcaccatttattaaatagggaatccattccccatttcttgtttttgtcaggtttgtcaaagatcagatagttgtggatatgcggcattatttctgagggctgtgttctgttccattggtctatatctctgttttggtaccagtaccatgctgttttggttactgtagccttgtagtatagtttgaagtcaggtagtgtgatgcctccagctttgttcttttggcttaggattgacttcgcaatgcgggctctgttttgattctatatgaactttaaagtagttttttccaattctgtgaagaaagtcattggtagcttgatggggatggcattgaatctataaattaccttgggcagtatggccattttcacgatgttgattcttcctacccatgagcatggaatgttcttccatttgtttgtatcctcttttatttcattgagcagtggttttgtagttctccttgaagaggtccttcacatcccttgtaagttggattcctaggtattttattctctttgaagcaattgtgaatggaagttcactcatgatttggctctctgtttgtctgttattggtgtataagaatgcttgtgatttttgcacattgattttgtatcctgagactttgctgaagttgcctatcagcttaaggagattttgggctgagatgatggggttttctaggtatacaatcatgtcatctgcaaacagggacaatttgacttcctcttttcctaattgaataccctttatttccttctcctgcctgattgccctggccggaacttccaacactatgttgaataggagtggtgagagaggacatccctatcttgtgccagttttcaaagggaatgcttccagtttttgcccattcattatgatattagctgtgggtttgtcatagatagctcttattattttgagatacatcccatcaatacctaatttattgagagtttttagcatgaagggttgttgaattttgtcaaaggccttttctgcatctattgagataatcacgtggtttttgtctttggttctgtttatatgctggattacatttattgatttgcatatgttgaaccagccttgcatcctagggatgaagctcacttgatcatggtgcataagctttttgatgtgctgctggattcggtttgccaatattttattgaggatttttgcatcgattttcatcagggatattggtctgaaattctctttttttgttatgttgctgctaggctttggtatcaggatgatgctggcctcataaaatgagttagggaggattccctctttttctattgattggaatagtttcagaaggaatggtaccagctcctccttgtacctctggtagaatttggctatgaatccatccggtcctggactttttttggttggtaagctattaattattgcctcaatttcagagcctgttattggtctattcggagattcaacttcttcctggtttagtcttgggagggtgtatgtgtcgaggaatttatccatttcttttagactttctagtttatttgtatagaggtgtttacagtattctctgatggtagtttgtatttctgtgggatcagtggtgatatccgttttatcattttttattgcgtctatttgattattctctcttttcttctttattagtctttctagtggtctatcaattttgctgatcttttcaaaaaaccagctcctggattcattgattttttgaagggtattttgtgtctctatttccttcagttctgctctgatcttagttatttcttgccttctgctagcttttgaatgtatttgctcttgcttctctagttcttttaattgtgatgttagggtgtcaattttagatctttcctgctttctcttgtgggcatttagtgctataaatttctctctacacactgctttgaatgtgtcccagagattctggtatgttgtgtctttgttctcgttggtttcaaagaacatctttatttctgccttcatttcgttttgtacccagtagtcattcaggagcaggttgttcagtttccatgtangtgagcagttttgagtgagtttcttatcctgagttctagtttgattgcactgtggtgtgagagacagtttgttataatttctgttcttttacatttgctgaggagagctttacttgcaactatgtggtcaattttggaataggtgtggtgtgatgctgaaaaaaaatgtatattctgttgatttggggtggagagttctgtagatgtctattaggtctgcttggtgcagagctgagttcaattccaggggatccttgttaactttctgtctcgctgatcggtctaatgtggatagtggggtgttaaagtctcccattattattgtgtgggagtctaagtctctttgtaggtcactcaggacttgcttttttttttttaactcatatttgtttttatttataggtaactaccacatgaattataaagacaacaaaggatgtcagaatgaacatggataggtgtatgcatactacggctaaggagaaacaatgttcctacatattatgggtagtgagaacattatctgtataacagggaactgtgattatttaaaaatatgcagaacttatttcatctgtgctttaaaaataactgtatacagtgttataagttgaaaagaactcaaaataactaataccaaatatacacctatgtattagaattcaaaaaagctgctttctgtgaagtcaatcagctatattaaaaaatgacacaaatccaaaacaagatgcatgttatatataaagggacattgtaagtttccttgctgcattaaacccatggtttaatccatgaaatttccttttaattatcatttagacagaagcatgcaaatagtctcaggatctacttaagaacctttcccaaatccactagttacactccccttttcaggaactaagcaggtattcgggtagctgcttcctcctctgcatcagctcggtttgcattaatttctgcaagtgttcagccaaaccatgcccattcatcattgcggggaacagcaatctgctctcccacatcgtatataacaatctgtccttcagaatcacccacagcaatctctctgccagaatgggtccatctcacatgattaagagcaggattaccctccacagaaatgctggcagttggtacctctgtgtcattattgagattccacaaatccaatctccccatgccatccacacaggcaaacagggctgggtgggtaggtgaccacataacatcataaacatagtctgcattgtcttcaaatgaatacaaaggcttgttattcttagttgtccaaagctttactgtccagtcaaacgatgaagtgacataaagatgtgagaagtctactgctccaacagctgcatgacaatggatgccagtgattggtccttgatgcccctcaaacatctcactgattccagctttgctgccatggcggcatgctgtgtacacagaacttcttcactcccaacaacaaagttgttgacgtctccaacagggaaggacatagatgtcacagctactgcttttgactgtttatgaaccaactccatgctatcctgtggatgggaaagcatgtccagactccatgaacaaatttttccatcagtagagatgctaatcagattgtgagcattttgtgttccaacaacgtttacacaatatacagggtgtgtgtgtgcagctgctgacagtggagttctttgcactggagttcttttattgctacggttatcccaaagcacagtttggcctgaatatgtaccaccaacaacaagatttggatgaaattttgcaaatgtggcagacatcacagctgactggcagtgaaacacatactctggggtagtttttttgtatttcatattccatacaagggccacaccatcaggctcatgaggggcatcttcattgttgttataggaagccacgagtaactccggatactgagatgaccaatccaaacaactaacaacccgatgctttgaccaaggttcgtcaaaaaattgtcaatttaatgacagtttagcacctgcttgaatctctccttctttgtcttccaaatctctcccactatagtgaaagaagatgttaatctgctcagaaagagctctttctacaattcttgtagaatggtcaaagaaacttaaaaattcctcagagtgcaagatttgttgcttttcttcttcagtcagctcatggggggagctttactatcattttcctcatctttctttaaagttttctcttcttcaggttcaataggtagtttaggagccactacatcatcatcttcctcttcatcttctttgggttgagccataactggagtctgagtttcctttgtatacgtgacaatttctcgaggaggaaagtcgacttgcgtgattttagccattccaagtttaataggtcctcgtctagatcccacggcgccatctccagagtcttggcttccagcttcacttggagtgctcacagatttggaggatggagacataggaggagggacaatgggggattctggagttagccccatgctttggagcaatgcttcagcttctcttcttcttttttcaagatctgattcttcttgcacaggagcaacagcttccttcttctgatctgtttctttttttttcctttcttcttcttttctcttcttttcctctctgatttgggccagttgctgcttcttacgttccaactcagcctttaattcacttttgtctgacatgtttgtgacctgtcaggtgactggatggggaagagtcctcccgcctgcaactttccggtaacgtccctcggctaagcccccaacaccaaccaggacttgctttatgaatctaggtgctgctgtattgggtgcatatatatttaggatagttagctcttcttgtttaattgatccctttaccattatgtaatggccttctttgtctcttttgatctgtgttggtttaaagtctgttttatcagagactaggattgcaacccctgccttttttttgttttccatttgcttggtagatcttcctccatccatttattttgagcctatgtgtgtctctgcatgtgcaatgcgtttcctgaatacagcacactgatgggtcttgactctttatccaatttgccagtctgtgtcttaattggagcacttagcccattcacatttaaggttaatattgctatgtgtgaatttgatcctgtcattatgatgttagctagtaattttgctcattagttgatgcagtttcttcctagcctggatggtctttacaatttggcatgtttttgcagtggctggtaccggttgttcctttccatgtttactgcttccttcaggagctctttcagggcaggcctggtggtgacaaaatctctcagcatttgcttgtctgtaaagtattttatttctccttcacttatgaagcttagtttggctggatatgaagttctgggttgaaaattcttttctttaggaatgttgaatattggcccccactctcttctggcttgtagagtttctgccaaaagatcagctgttagtctgatgggcttccctttgtgggtaacccgacctttctctctggctgccattaacattttttccttcatttcaactttggtgaatctgacaattatttgtcttggagttgccgttctcaaggagtatctttgtggcattctctgtatttcctgaatttgaatgttggcctgccttgctagattggggaagttctcctggataatatcctgcagagtgttttccaacttggttcccttctccccgtcactttcaggtacaccaatcagatgtagatttggtcttttcacatagtcccttatttcttggaggctttgtttgtttctttttattcttttttctctaagcttctcttctcgcttcatttcattcatttgatcttccatcactgataccctttcttccagttgattgcatcagttactgaggcttgtgcattcatcacatagttctcgtgccatggttttcagctccattgggtcctttaaggacttctctgcattggttattctagttagccattcgtctaattttttttcaaggtttttaacttctttgccatgggttcgaacttcctccattagctcggagtagtttgatcgtctgaagccttcttctctcaactcgtcaaagtcattctccatccagctttgttccattgctgctgaggagctgcattcctttggaggaggagaggcgctctgctttttagagtttccagtttttctgctctgttttttccccatctttgtggttttatctacctttggtctttgatgatggtgatgtacagatggggttttgtgtggatgtcctttctgtttgttagtttcccttctaacagtcaggaccctcagctgcaggtctgttggagtttgctggaggtccactccagaccctgtttgcctgggtatcagcagcggagtctgcagaacagcagatactggtgaacagcaaatgttgctgcgtgatcgttcctctggaagttttgtctcagaggagtacccggccatgtgaggtgtcagtctgcccctactggggggtgcctcccagttaggctactcgggggtcagggacccacttgaggaggcagtctatccattctcagatctcaagctgtgtgctgggagaaccactattctcttcaaagctgtcagacagggacacttaagtctgcagaggtttctgctgccttttgtttcgctatgccgtgcccccagaggtggagtctacagaggcaggcaggcctccttgagctgtggtgggatccacccag

SEQ ID NO: 12841 - DNA, 12135 bp, Homo sapiens
tcccacctatgagtgagaacatgtggtgtttggttttctgtctttgtgatagtttgctgagaatgatggtttccagcttcatccatgtccctacaaagcacatgaactcatcattttttatagctgcatagtattccatggtgtctacgtgccacattttcttaatccagtctatcactgatggacatttgggttggttccaagcccgctattgtgaatagtgccaccataaacatacgtgtgcatgtgtctttatagcagcatgatttacaatcctttgggtatatacccagtaatgggatggctgggtcaaatggcatttctagttctagatgcttgaggaatcaccacactgtcttccacaatggttgaactagtttacagtcccaccaatagtgtaaaagtgttcctatttctccacatcctctccagcacctgttgtttcctgactttttaatgatcactgttctgactggcgtgagatggtttctcattgtggttttcatttgcatttctctaatgaccagtgataatgagcattttttcatgtgtctgttggctgcataaatgtcttcttttgagaagtgtctgttcatctcctttgcccagtttttgatagggttgattttttttcttgtaaatttgtttaagttctttgtagattctggatattagccctttgtcagatgagcagattgtaaaaattttctcccattctttaggttgcctgttcactctgatggtagcttcttttgctgtgcagaagctctttagtttaattagatcccattggtcaattttggcttttgttgccattgcttttggtgttttagtcatgaagtccttgcccatgcctatgtcctgaatggtattgcctaggttttcttataagcttgttatggttttgagtctaacatttaagtctttgatctatcttgaattaatttttgtataaggtgtaaggaagggatccagtttcagctttctacatatggctagccagttttcccaacacgctttattaaataggaaatcttttccccatttcttgtttttgtcagatttatcaaagatcagatggttacaggtgtgtggtgttatttctgagggctctgttctgttccattcatctatatatctgttttggtaccagtaccatgctgttgtggttactgtaggcttgtaatatagtttgaagtcaggtagcctgatgcctccagctttgttctttttgcttaggattgtcttggcaatgcaggctcttttttggttccatatgaattttaaagtagttttttccaattctgtgaagaaagtcattggtagcttgatggagatggcattgaatcaataaattaccttgggcagtatggccattttcacaatattgattcttcctatccatgagcatggaatgttcttccatttgtttgtgtcctcttttatttcattgagcagtggtttgtagttctccttgaagaggtccttcacatcccttgtaaattgtattcctaggtatttaattctctttgtagcaattgtgaatgggagttcactcatgatttggctgtctgtttgtctgttattggtgtataggaatgcttgtgatttttgcccattgattttgtgtcttcagactttgctgaagttgcttatcagcttaagaagattttgggctgagacaatggggttttctaaatatacaatcatgtcatctgcaaacagggacaatttgacttcctcttttcctaactgaatacactttatttctttctctttcctgattgccctggccagaacttccaacactatgctgaatagcagtagagagagagggcattcttgtcttgtgccggttttcaaatatggtgatttggtttttgttgaattgtttaatttccttatagattttggataacaggctttgttacacgcatcttttgtgaatatattctcctattctctggttgtctgtttatacttagttttgttttttttttttcctctgcagaagctccttaatttattccacttatcaattttggtttttgttacaattgctttcggggtcttagtcataacttcttcaccaaaattgatgtccaacatggtatttcctaagttttcttattttttttttaggtctacatttaagtctttagtccatcttgagttattttttgtatagggtgaaaagaagggtgccagttctaatctgctgcatatggctagccagttattccagcatcatttattcaacaggaaatattttccacattgtttgttattgttgactttgttgaagaacatgtggttgtacgtgtgtggctttatttctgggttatataatacgttccattggtctacgtgtctgtttttgtgccagtaccatattattttggttactatagccttgtagcatattttaaagtcagttaatatgatgcccctagctttgttcttttgcttagagttcctttggctattcatgccctttttttgttccatatgaattttagaataatttttttaattactggaaaaatgacattttaattacgggaaaaatgacattggtggtttaataagaaaaatagtgaatctttaaattgtaaggtcattttaatgatattgattctttttatccatgagaatggaatgtctttccttttgttttcattaccgctaatttttttcagcagtgtttggtaattttcattgtagagacctttcacttccttggtaagctgtatttctaggtattttattttttgtggcttttgtaaatggcattgtattcttgatttggctctcagcttggaatttattgttatatagaaaagctactaatatttgtacactaattttttatccttaaattttactgaaattgttagtcagttctacgagccctctgacagagtctatgaggttttctaggtatagaatcatattgtctgtgaagagagttagttttacttcctgtcttcttatttggatgctttttatttctttctcttgcctgattgctctggctaggactttcaatactatattgattaagagtggtgtgagtgggaatccttgtcttgttctagttctcaagagtaatggttccagcttttgcctgttcagtataatgttggccacggattttcatatatggctttaatattttaagaagccactatgttaaactaaattcatgcactaggccttaacaaaccagaccaaaccaaaaagagtcactcatactaactacaacataatcaaactaaaagttaaaagaaaaaaatatcaaaacagaacaagttttttttttctctctctcttaaaaatactggagggaaggtggaacaatatgacaacatagaaggctccaataatcatcccccctgacaggacaccaatttaacaactatctgttagaaaaaaaaacagtcttgaataaacaataccatccctcccccatctcttgcccctacctctgcagctactgtgtgctgcagaaagcatttccgagagctgggggagagaacacacagcaattgtgaggcattgaactcagtgctgtcctgttacagcagaaaggaaagccagaacagactcagctgatacctgcccacaaatggagcatttaaaccagccctagaaagagagaattgtcaatccaggagatggaacttgagttcccgcaagcctctcccccatgggctaacatgctccagagtatctaaatactcttaaaaggcagcctagatcacaaggactccaacttttaggtgagtcctagtgctgaactgggcccagagtcagtagacagggtgggtggggaacgtgacctattgagacatcagctggtgatggctaagggagtgctggcacctcccctccccaaaacctcaggctgcacagctcacagctccaaaagagatcctttccttccacttgaggcaaggagagagaagagtcaaaaagactttgtcttgcattttggatacccagtcacccacagcaagatagggcaccagtcagagtcatgaggccctggttctagtccctagctccctgatgatatttctagacaactctggcccagaaaggctgtgttgaagagaaggacccagtcctagcagcatccatcacctgatgaataaatagtccttaagccctgaataatcaacggtgatactaagatactaaattgcaaactttgagtgagactctgagacttgcaggcttcgggtaccaacctggccacagaggtgcaaagttcaggacgagaggggagcccacttccctaatagtgagttataggccaggcagcattaaatacaagctgcctgaggcccttaagccttaatggaccatcagtggtagtcttgtagaacttcccaggggtctgtcatggtggtggccatggagtgagactcttctgcctttggaaagggtaggaagagtgggaaggactgcatcttgtagtttgagtgccatctcagccacagtaccacaaaacaccaggtatacttctaaagattttgactctagtccctggctcctgacaggacttttggactcacctatggcctagaggacctcaccatcctggagggaaggacacaagctcggctggcgttgccacctgctgagtgcagagccttagggttttgagcaaacatatggtattgtttattcaagactgttttttttctaacagatagttgttaaacaaagcatagttacagaagcccatgggtgggatcaggtgctgtgttggcttcaggtttgaaccagtgcagtcatagtggtggaggccacagggttgcttgtgtcacccacctgcagcttcagatggctcaaaagagagagactttgtttgtttgagagaaagtttgaagaaagaacaagagcatctgtctggtaatgcagagaattctccaaaattttgtccgagaacatcacgatggtaactcaatgaatctgcaagaactgcagcattactgagatttcattatcacctaaagcagatacagcttagacaacacccaaattctttcaaataactgaaaaacctaccaagaaggactggtacatacaagctcagactgcaaggactacaataaatacctaattcatcaatgcccagatacagatgaacaagtatcaagaaaatccaagaaaacataacctcaccagatacactaaataaggcaccagagaccaatcctaaagaaacagaaatatgtaacctttaagacagagaattcaaaatagctctgtttaggaagctcaaagaaattcaagataacacagaaaaagaattcagaattctatcagataaagctaacaaaaagattgaaataattttttaaaaatcaagaagacatcttggagtttaacaatccaattggcatgctgaaaaatgcatcaaagtcttttaataacagaactgatcaaactaaagaagaattagtgagcttaaagatacgctatttaaaaatacacagtcagaggagacaaaaataaaaataaaaagcaatgaagcactgctataagatctaaaaaacaaccccaaaatggaaagtctaagagttactggccttaaagaggaggtagagaaagagataggatagaaagtttattcaaaggaataaaaacagagaacttctcaaacctagagaaagatattagtatctaaggttatggaacatcaagcagatttaatccaaagaagactacctcaaggcatttaaggataaaactcccgaaggttaaggatttttttaaaaaaagtattctaaaagcagcaacagaaaagaaagaaatgatataccatggagctccagtatgtatggcagcagacttttcagtgcataccttgcattccagaagagagtggcatggcatatttaaacggctgaaagaaagaagattttaccctagaatagtgtatctgtgaaaaaaataaataaataaaaataaaaataaaaataaatccttcaaaaatggagaaataaagactttctcagacaaatggtgagggattttgtcaacacaaagcctgtcctacaagaaatgctagagggagttctttatcagaaagaaatagttataaataagcaataagtaagcacctcaagatacaaatttctctggtaacagtaagtacacagtaaaacacagaatattgcaccactctaattgttgtgtataaactactctttttttatgctatccctccctcctcccccaccccacaacagtacccagagtgtgatgttccccttcctgtgtccatgtgttctcattgttcagttcccacctatgagtgagaatttgcggtgtttggttttttgttcttgcaatagtttactgagaatgatgatttccaatttcatccatgtccctacaaaggacatgaactcatcattttttatggctgcatagtattccacggtgtatatgtgccacattttcttaatccagtctatcattgttggacatttggcttggttccaagtctttgctattgtgaatagtgccacaataaacatatgtgtgcatgtgtctttatagcagcatgatttatagtcctttgggtatatacccagtaatgggatggctggacaaatggtatttctagttctagatccctgaggaatcgccacactgacttccacaatggttgaactagtttacagtccatccaacagtgtaaacgtgttcctatttctccacatcctctccagaacctgttgtttcatgactttttaatgattgccattttaactggtgtgaaatggtatctcattgtggttttgatttgcatttctctgatggccagtgatgatgagcattttttcctgtgttttttggctgcataaatgtcttcttttgagaagtgtctgttcatgtcctttgcccactttttgatggggctgtttgttttttcttgtaaatttgtttgagttcagtgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgtttttggtgttttagacatgaagtccttgcccatgcctatgtcctgaatggtattgcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagtgaatcctttccccatttcttgtttttgtcaggtttgtcaaagatcagatagttgtagataagcggcattatttctgagggctctgttctgttccattgatctatatctctgttttggtaccagtaccatgctgttttggttactgtagccttgtagtatagtttgaagtcaggtagtgtgatgcctccagctttgttcttttggcttaagattgacttggtggtgcaggctcttttttggttccatacgaactttaaagtagttttttccaattctgtgaagaaagtcatgtgtagcttgatggggatggcattgaatctgtaaattaccttgggcagtatggccattttcacaatattgattcttcctacccatgagcatggaatgttcttccatttgtttgtatcctcttttatttcattgagcagtggtttgtagttctccttgaagaggtccttcacatcccttttaagttggattcctaggtattttattctctttgaagcaattgtgaatgggagttcactcatgatttggctctctgtttgtctgttgttggtgtataagaatgcttgtgatttttgtccattgattttgtatcctgagactttgctgaagttgcttatcagcttaaggagattttgggctgaggcaatggggttttctagatatacaatcatgtcatctgcaaacagggacaatttgacttcctcttttcctgattgaataccctttatttccttctccttcctaattgccctggccagaacttccaacactatgttgaataggagtggtgagagagggcatccctgtcttgtgccagttttcaaagggaatgtttccagtttttgcccattcagtatgatattggctgtgggtttgtcatagatagctcttattatttttagatacgtcccatcaatacctaatttattgagagtttttagcatgaagggttgttgaattttgtcaaagtccttttctgcatctattgagataatcatgtggtttttgtctttggttctgtttatatgctggattacatttattgatttgcgtgtattgaaccagccttgcatcccagggatgaagcccacttgatcatggtggataagctttttgatgtgctgcttgattcggtttgccagttttttattgaggatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctggactctttttggttggtaagctattgattatgccagaatttcagctcctgttattggtctactcagagattcaacttctttctggtttagtcttgggagagtgtatgtgtcgaggaatgtatccatttcttctagattttctagtttatttgcatagaggtgtttgtagtattctctgatggtagtttgtgtttctgtgggattggtggtgatatcccctttatcattttttattgcgtctatttgattcttctctctttttttctttattagtcttgctagcggtctatcaattttgttgatcctttcaaaaaaccagctcctggattcgttaattttttgaatggttttttgtgtcttctatttccttcagttctgctctgattttagttatttcttgccttctgctagcttttgaatgtgtttgctcttgctttactagttcttttaattgtgatgttagggtgtcaattttggatctttcctgctttctcttgtgggtatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggctgttcagcttccatgtagttgagcggttttgagtgagattcttaatcctgagttctagtttgattgtgctgtggtctgagagatagtttgttataatttctgttgttttacatttgctgaggagagctttacttccaagtatgtggtcaattttggaataggtgtggtgtggtgctgaaaaaaatgtatattctgttgatttggggtggagagttctgtagatgtctattaggtccacttgatgcagagctgagttcaattcctgggtatccttgttgactttctctctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattaattaatggccttctttgtctcttttgatctttgttggtttaaagtctgttttatctgagactaggattgcaacccctgcctttttttgttttccatttgcttgatagatctccctccatccttttattttgagcctatgtgtgtctctgcccatgagatgggtttcctgaatacagcacactgatgggtcttgactctttatcccatttgccagtctgtgtcttttattggagcatttagtccatttacatttaaagttaatattgttatgtgtgaatttgatcctgtcattatgatgttagctggttattttgttcgttagttgatgcagtttcttcctactctctatggtctttgcatcttggcatgattttgcagcggctggtactgggtgttcctttccatgtttagtgcttccttcaggagctcttttagggcaggcctggtggtgacaaaatctctcagcatttgcttgtctgtgaagtattttatttctccttcacttatgaagcttagtttggctggatatgaaattctgggttaaaaattcttttctttaagaatgttgaatattggaccccactctctactggcttgtagagtttctgccaagagatccgctgttagtctgatgggcttccctttgagggtaacccgacctttctctctggctgcccttaacattttttccttcatttcaactttggtgaatctgacaattatgtgtcttggtgttgctctcctcgaggagtatctttgtggcgttctctgtatttcctgaatctgaatgttggcctgacttgctagattggggaagttctcctggataatatcctgcagagtgttttccaatttggttccattctccctgtcactttcaggtataccaatcagacgcagatttggtcttttcacatagtcccatatttcttggtggctttgctcgtttctttttactcttttttctctaaacttcccttctcacttcatttcattcatttcgtcttccatcgctgataccctttcttccagttgatcgcattggctcctgaggcttctgcattcttcatgtagttctcgagcctaggttttcagctccatcagctcccttaagcacttctctgtattggttattctagttatacattcttctaaatttttttcaaagttttcaacttctttgcctttggtttgaatgtcctcctgtagctcggagtaatttgatcatctgaagccttcttctctcagctcgtcaaagtcattctccatccagctttgttctgttgctggtgaggaactgcattcctttggaggaggagaggtgctctgctttttagagtttccagtttttctgctctgttttttccccatctttgtcgttttatctacttttggtctttgatgatggtgatgtacagatgggtttttggtgtggatgtcctttctgtttgttagttttccttctaacagacaggaccctcagctgcaggtctgttggagtacccggccgtgtgaggtgtcagtctgcccctgctgggggtgcctcccagttaggctgctcaggggtcagggatcagggacccacttgaggaggcagtctgcgcattctcagatctccagctgcgtgctgtgagaaccactgctctcttcaaagctgttagacaggaacatttaagtctgcagaggttactgctgtctttttgtttgtctgtgccctgccccaaggtggagcatacagaggcaggcaggcctccttgagctgtggtgggctccacccagttggagcttcctggctgctttgtttacctaagcaagcctgggcaatggcaggcgcccctcccccagccttgctgccaccttgcagtttgatctcagactgctgtgctagcagtcagcaagactctgtgggcgtaggaccctctgagccaggtgcggaatataatctcctggtgcgccgttttttaagcccatcggaaaagcacaatatttgggtgggagtgacccaattttccaggtgccgtctgtcaccactttctttgactaggaaagggaactccctgatcccttgtgcttcccgagtgaggcaatgcctcaccctgcttcggctcgtgcacggtgcgtgcacccactgacctgctcccactgtctggcactccctagtgagatgaacctggtacctcagatggaaatgcagaaatcacccgtcttctgcgtcgcttacgctgggagctgtagaccggagctgttcctatttggccatcttggctcctcccccgatttctcttttttt

SEQ ID NO: 12842 - DNA, 5479 bp, Homo sapiens
tgtgatttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcacagtggttttgatttgcatttctctgatggccagtgatggtgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttcattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaaggaatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttcgtaccagtaacatgctgttttggttactgtagccttgtagtatagtttgaagtcaggtagtgtgatgcctccagctttgatcttttggcttaggattgacttggtgatgcgggctcttttttggttccatatgaactttaaagtagttttttccaattctttgaagaaagtcattggtagcttgatggggatggcattgaatctgtaaattaccttgggcagtatggccattttcacgatattgattcttcctacccatgagcatggaatgttcttccatttgtttgtgtcctctttaatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagactgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacatactgctttgaatgcgtcccagagattctggtatgtggtgtctttgttctcgttggtttcaaagaacatctttatttctgccttcatttcgttatgtacccagtagtcattcaggagcaggttgttcagtttctcatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaactcctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagatcggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttctgctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttcaacactgtgatttttgatacatttttttttttttacattgc

SEQ ID NO: 12843 - DNA, 31871 bp, Homo sapiens
ttcaagtagttttttccaattctgcagagaaagtcattggtagcttgatggggatggcattgaatctataaattaccttgggcagtatgaccattttcacgatattgattcttcctacccatgagcatggaatgttcttccttttgtttgtttcctcttttatttccttgagcagtggtttgtagttctccttgaagaggtccttcacatcccttgtaagttggattcctaggtattttattctttttgaagcaattgtgaatgggagttcactcatgatttggctctctgtttgtctgttattggtgtataagaatgtttgtgattattgtacattgattttgtatcctgagactttgctgaagttgcttatcaacttaaggggattttgggctgagacaatggggtttcttagacatacaatcatgttgtctgcaaacagggacaatttgacttcctcttttccgaattgaataccatttatttccttctcatacctaattgccctggccagaacttccaacactatgttgaataggagtggtgagagagggcatccctgtcttgtgccagttttcaaagggaatgcttccagtttttgtccattcagtatgatattggctgtgggtttgtcacagatagctcttattattttgacatacatcccattaatacctaatttattgagaggttttagcacgaagggttgttgaattttttttgaatgttttttattttatttttttttattttaagttttagggtacatgtgcacattgtgcaggttagttacatatgtatacatgtgccatgctggtgcgctgcacccactaactcgtcatctagcattaggtatatctcccaaagctatccctcccccctccccctaccccacaacagtccccagagtgtgatattcccattcctgtgtccgtgtgttctcattgttcaattcccacctataagtgagaatatgcagtgtttggttttttgttcttgtgatagtttactgagaatgatgatttccaatttcatccatacccctacaaaggacaagaactcaacaatttttatggctgcatagtattccatggtgtatgtgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaattggatggctgggtcaaatggtatttccagttctagatccaggaggaatcgcaacactgacttccacaatggttgatctagtttgcagtcccaccaaccatgtaaaagtgttcctatttctccacatcctttccagcacctgttgtttcctgactttttaatgatcaccattctaactggtgtgagatggtatcacattgtggttttgatttgcatttctctgatggccagtggtgatgagcattttttcatgtgttttttggctgcacaaatgtcttcttttgagaagtgtctgttcacgtcctacacccactttttgatggggttgtttgtttttttcttgtaaatttgtttgagttcattgtagattctggatattagccttttgtcagatgagtaggttgcaaaaattttctcccattttgtaggtttcctgttcactctgatggtagtttcttttgctgtgcagaggctctttagtttaattagatctcatttgtcaattttggcttttgttgccattgtttttggtgttttagacatgaagtccttgcccatgcctatgtcctgaatggtaatgcctagggttgcttctagggtttttatggttttaggtctaacgtttaagtctttaatccatcttgaattgatttttgtataagatgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgtttcggtaccagtaccatgctgttttggttaccgtagccttgtagtatagtttgaagtcaggtagtgtgatgcctccagctttgttcttttggcttaggagtgacttggcgatgtgggctctcttttggttccatatgaactttaaagtagttttttccaattctgtgaagaaaggcattggtagcttgttggggatggcattgaatctgtaaattaccttgggcagtatggtcattttcacattattgattcttcctacccatgagcatggaatgttcttccatttgtttgtatcctcttttatttccttgagcagttttttgtacttctccttgaagaggtccttcacatccattgtaagttggattcctaggtattttattccctttgaagcaattgtgaatgtgagttcactcatgattttgctctctgtttgtctgttgttggtgtataagaatgcttgtgatttttgtacattgattttgtatcctgagattttgctgaagttgctcatcagcttaaggagactttgggctgagacaatggggttttctagatatacgatcatgtcatctgcaaacagggacaatttgacttcttcttttcctaattgaataccctttatttccttctcctgcctaattgccctggccagaagttccaacactatgttgaataggagtggtgagagagggcatccctgtttgtgccagttttcaaagggaatgcttccagtttttgcccattcagtatgatattggctgtgggtttgtcatagatagctcttattattttgaaatacgtcccatcaatacctaatttattgagaattcttagcatgaaggttgttgaattttgtcaaaggccttttctgcatctattgatataatcatgtggtttttgtctttggctctgtttatatgctggattacattcattgatttgcatatattgaagcagccttgcatcccagggatgaagcccacttgatcatggtggataagcttttggatgtgctgctggattcgttttgcctgtattttattgaggatttttgcatcaatgttcatcaaggatattggtctaaaattctctttttttgttgtgtctctgcctggctttggtatcagaatgatgctggactcataaaatgagttagggaggattccctctttttctgttgattggaatagtttcagaaggaatggtaccagttcctccttgtacctctggtagaattcggctgtgaatccatctggtactggactctttttggttggtaagctattgattattgccagaatttcagagcctgttattgttctattcagagattcaacttcttcctggtttagtcttgggagggtctatgtgttgaggaatttatccatttcttctagattttctagtttatttgcgtagaggtgtttgtagtattctctgatggtagtttgtatttctgtgagatcagtggtgatatcccctttatcattttttattgcgtctatttgaatcttctctctttttttctttattagtcttgcttgcggtctatcaattttgttgatcttttcaaaaaaccagctcctggattcattaatttttgaagggttttttgtgtctctatttccttcagttctgctctgattttagttatttcttgccttctgctagcttttgaatgtgtttgctcttgcttttctagttcttttaattgtgatattagggtgtcagttttggacatttcctgctttctcttgtgggcgtttagtgctatagatttccctctacacactgctttgaatgcggcccagagattctgatatgttgtgtctttgttctcgttggtttcaaagaacatgtttctttctgccttcatttcgttatgtacccagtagtcattcaggagcaggttgttcagtttccatgtagttgagtggtttgagtgagattcttaatcctgagttctagtttgattgcactgtggtctgagagatagtttgttataatttctgttcttttacatttgctgaggagagctttacttccaagtatgtggtcaattttgtaataggtgtggtgtggtgctgaaaaaaatgtatattctgttgatttgggttggagagttctgtagatgtctattaggtctgcttggtgcagagctgagttcaattcctgggtatccttgttgactttctgtcttgttgatctgtctaatgttgacagtggggtgttaaagtctcccattgttaatgtgtgggagtctaagtctctttgtggatcactcaggacttgctttatgaatctgggtgctcctgtattgggtgcatgtatttttaggatagttagctcttcttgttgaattgatccctttaccattatgtaatggccttctttgtctctttttatctttgttggtttaaagtctgttttaccagagactaggattgcaacccctgcctttttttgttttccatttgcttggtagatcttcctccatccttttattttgagcctatgtgtgtctctgcacgtgagatgagtttcctgaatacagcacactgatgggtcttgactctttatccaatttgccagtctgtgtcttttaattggagcatttagtccatttacatttaaagctaatattgttatgtgtgaatttgatcctgtcattatgatgttagctggttattttgctcgttagttgatgcagtttcttcctagtctcgatggtctttacatttttggcatgattttgcagtggctggtaccggttgttcctttccatgtttagtgcttccttcaggagcttttttagggcaagcctggtggtggcaaaatctgtcagcatttgcttgtctgtaatgtatttcatttctccttcgcttatgtagcttagtttggctggatatgaaattctgggttgaaaattattttctttaagaatgttgaatattggcccccactctcttctggcttgtagggtttctgccaagagattcactgttagtctgatgggcttccctttgagggtaacccgacctttctctctggctgcccttaacattttttccttcatttcaactttgctgaatctgacaattatgtgtcttggagttgctcttctccaggagtatctttgtggcgttttctgtatttcctgaatctgaatgttggcctgccttgctagattggggaagttctcctggataatatcctgcagagtgttttcctacttggttccattctccctgtcactttcaggtacaccaatcagacgtagatttggtctcttcacatagtcctatatttcttggagggtttgctcatttcttttcattcttttttctctaaacttcccttctcacttcatttcattcatttcatcttccatcgctgataccctttcttccagttgaatgcattgggctcctgaggcttccgcattcttcacgtagttctcgagccttggttttcagctccatcagctcctttaagcacttctctgcattggttcttctagttatacattcttctaaatttttttcaaagttttcaacttctttgcctttggtttgaatgtcctcccatagctcagagtaatttgatcgtctgaagccttcttctcttagctcgtcaaagtcattctccatccagatttgttccattgctggtgaggaactgcgttcctttggaggaggggaggtgctctgctttttagagtttccagtttttctcttctcttttttacccatctttatggttttatctacttttggtctttgatgatggtgatgtacagatgggtttttggtgtggatgtcctttctgtttgttagtttttcttctaacagacaggaccctcagctgcatgtctgttggaataccctgccttgtatggtgtcagtgtgcccctgctggggggtgcctcccagttaggctgctcgggggtcaggggtcagtgtcccacttgaggaccagtcttccagttctcagatctccagctgcatgctgggagaaccactgctctcttcaaagctgtcagacagggacatttaagtctgcagaagttactgctgtctttttgtttgtctgtgccctgcccccagacgtggagcctacagaggcaggcaggcctccttgagctgtggtgggctccacccagttcgagattccaggctgctttgtttacctaatcaagcctgggcaatggtgggcaccctcccccagactcactgccaccttgcagtttgatctcagactgctgtgctagcaatcagcgagactccgtgggcataagaccctccgagccaggttcaggatataatcttgtgttgtgtcgttttttaagcccattggaaaagcacagtattcgggtgggagtgacccgattttccaggtgctgttcgtcacccctttctttgacttggaatgggaactccttgaccccttgcacttcccaagtgagacaatgcctcaccctgcttcggctcatgcacagtgcatgcacccactgacctgcgcccactgtctggcactccctagtgagatgaacctggtacctcggatggaaatgcggaaatcaccgtcttctgcatcactcatgctgggagctgtagaacagagctgctcctattcggtcatcttggctcctccccctagggttgttgaattttgtcaaaggccttttctgcaactattgatataatcatgtggtttttgtctttggttctgtttatatgctggattacatttattgatttgtgaatgttgaaccagccttgcatcccagggttgaagaccacttgatcatggtggataagctttttgatgtgctgctggatttggtttgccagtattttattgaggatttttgcatcaatgttcatcaaggatattggtctaaaatcctcttttttggttttgtctctgccaggctttgttatcagggtgatgctggcctcataaaatgagctagggagattacctctttttctattgaatggaatagtttcagaaggaatggtaccagttcctccttgtacctctggtagaattcagctgtgaatccaaaccataaaaaccctagaagaaaacctaggcattacctttcaggacataggcatgggcaaggacttcatgtctaaaacaccaaaagtaatggcaacaaaagccaaaattgacaaatggggtctaattaaactaaagagcttctgcacagcaaaagaaactatcatcagagtgaacaggcaacctacaaaatgggagaaaattttcacaacctactcatcaaacaaagggctaatatccaaaatctacagtgaactccaacaaatttacaagaaaaaaacaaacaactccatcaaaaagtgggtgaaggacatgaacagacacttctcaaaagaagacattcatgcagctaaaaaacacatgaaaaaatgctcaccatcactggccatcagagaaatgcaaatcaaaaccacagtgagataccatctcacaccagttagaatggcattcattaaaaggtcaggaaacaacaggtgctgggcaggatgtggagaaatagaacacttttacactgttggtgggattttaaactagttcaacaattatggaagtcagtgtggcaattcctcagagatctaggactagaattaccatttgacccagccatcccattactgggtatatacccaaaggactataaatcatgctggtataaagacacatgcacacttatgtttattgcatcactattcacaatagcaaatacttggaaccaacccaaatgtccaacaaggatagactggattaagaaaatgtggcacatatacaccatgaaatactatgcagccatgaaaagtgatgagttcatgtccgttataggacatggatgaaattggaaatcaacattctcagtaaactatcgcaaggacaaaaatcaaacaccgcatgttctcactcataggtgggaattgaacaatgagaacacatggacacaggaaggggaacatcacactctagggactcttgtggggtgggaggagaggggagggatagcattaggagatatacctaatgttaaatgaggagttaatgggttcagcacaccagcatggcacatgtatacatatgtaactaacctgcacattctgcacatgtaccttaaatcttaaagcataaaaataataaaaaaaaacaaaaaacaaaaagaagtttctcagaatacatctgtctaatttttatgtgaagatacttccttttccactttaagacgcaaagttctccaaatatccacatgcagatcctattaaaagagtgtgtcaaaactcctcaatcaaaagaaaagttcaaatctgtgagatgaatggacacatcagaaagaagtttctcagaatgcttctgtctaatttttacgtgaagacaactccttttccactataggccacaaagcactccaaatatccatttgcagatactacaaaaagactgtttccaaactgctgaaacaaaagaaatgctcaactctgtgacatgaatgcacatattacaaagaagtttctcagaacgattctgtctggtttttatgtgagaatatttccttttccaccataggcctcgaactcctccaaatatccagttgcagattctacaaaaagagtgtttcaaaactgctcagtcaaatgaaaggttcaactctgtgagatgaatgcacacatcacaaagaggtctctcagaatgcttctgactagcttttacatgcaaatatttatttttccactataggctgcagagctctacaaatatccatttccagtaccacaaaacgagtgtttcaaaactgctcaatcaaaagaaaggttcaactctgtgagttgaatgcacacatcacaaagaagcttctcagaatgcttctgtatagtgtttatgtgaagatatttcctgttccaccaaaggctacaaagtgctccaaatatccacttgcagattctacaaaaacaaagtttcaaaactgctcaatcaaaggaaaggttcaactctgacagataaatgctcacatcacaaagatgtttctctgaatgcttctgcctagttttatgtgaagataactcctgctccacgataggctgcaaagcgctccaaacacccacttacagattctacaaaaagagtgtttccaaactgctcaatcaaaagaaaggttcaactctgtcagatgaatgggcacatcacaaagaagtttctcagaatgcttctgtctagtttttatgtgaagatatttccttttccaacataggcctcaaagtgctgcaaatacccacttgcagatgcttcaaaaagactgtttcaaaactgctcagtcaaatgaaagtttcaactctgtgagatgaatgcaaacctcacaaagaagtctctcagaatgcttctgactagtttttacatgcagatatttatttttccactataggctgcagagcactacaaaaatccatttccagataacacaaaacgagcgtctcaatactgcttaatcaaaagaaaggttcaactctgtgagttgaatgcacacatcacaaagaagcttctcagaatgcttctgtctagtttttatgtgaagatatttccttttccccaaaggccacaaagcgctccaaatatccacttgcagattctacaaaaacagtgtttcaaaactgctcaatcaaaggaaaggttcaattctgagagataaatgttcacatcacaaagatgttcctctgaatgcttctgcctagtttttatgttaagatttctcgttttccatgatgggccgcagagtgctccaaacacccacttgcaaattctacaaaaagagtgttaccaaactgctcagtcaaaagaaagtttcaactctgtgagttgaatatacacatcacaaagtttatcagaatacttcttagtagtttttatgtgaagatatttccttttccacaataggccttgaagctctccaaatatccacttgcagattctacaaaaacagtgtttccaaactgctcaatcaaatgaaagtttcgactgtgtgagatgaatgcacacatcacaaagaagattctcagaatgcttctgtgcagtttttatgtgaagatatttccttttccacaacaggcatcaaagcgctccaaatattcacttgcagattctacgaaaagggtgtttcaaaactcctaaatcaaaataaaggtgcaactctgtgtgatgaatgcacacatcacaaagaagtttctcagaatgcttctgcgtagttcttatgtgatgatatttccttttccaccataggtcgcaaagggctccaaatatccccctgctgattttccataaagagtatttcaaaacagctcaatcaaaagaaagtttcaagtctgtgagatgaatgcacacatcacaaagaagtttctcagaatgcttctgtgcagtttttgtaaagatatttacttatccaaaagaggcctcaaagcgcttcaaatatccacttgctgattctataaaaagggtgtttcaaaactgctcaatcaaaagaaaagttcaactctgtgagatgaatgcacacatcacaaagaagtttctgagaatgtttctgtgtagtttttatgtgaatatattttcttttgcacaataggcctcaaagcgcttcaaatatccacttgcagattctataaaaagggtgtttgcaaactgctctatcaaaagaaacgttcagcactgtgaggtgaatgtgcacattacaaagacgtttctcagaatgcttctgtgtagtttttatttagataggttcaacacactgagttgaaggcacgtatcccaaagaaggttttcagaatgcttctgtgcagtttttatgtgaagatatttccttttccactataggcatcaaagcgttccgaagatccacttgcagattacacaaaaagagtgtttccaaactgctcaatgaaaagaaaatttcaactctgtgagatgaatggacacatcacaaaaaagtttgtcagaatgcttctgtgtagttttcatgtgaagctattttcttttccaccataggcctcatcatgctccaaatatccacttgcagattctaaaaaaagagtgtttcaaaactgctccatcaaaagaaatgttcaactctgtgagatgaatgcacacatcacaaagaagtttctcagaatgcgtccatgtagtttttatgtgaatatatttccttttccaccatagtccaaaaagggctcaaaatattcactttcagtttctacaaaaagagagaattaaaattgctgtttcaaaagataagtccatctctttgagatgaatacataaatcacaatatagtttctcagaatgctttggcatagtttttatgtgaagatatttccttttccaccataggtctcaaagttctccaaatatccacttgcagatactacaaaaagagtgtttcaaaactgctcaatcaaaggaaaagtgcaactcagtgaaatgaatgcacacatcaaaaagaagtttctctcaatgcttcagtgtagatttatgtgtagatatttccttttccataataggcctcaaagggctccaaatatccacatgcagatgctacaaaaagagtgtttcaaaactgctcaaactgttcatcaaagaaaggttaaactctgtgtgatgaacgcacacatcacaaagaagtttctcagaattcttcagtgtaatttttatgtgaagatatttccttttccacgataggcctgaaagagctccaaatatccacttgcagattaataaagtgtgtttccaaactactcaatcaaaagaaagattcaagcctgtgaaatgaatgcacacataacaaagaaatttctcagaatgcttctctgtagtttttatgtggagatatttccttttccgacataggccactaagggctccaaatacccacttgcagatactacaaaaagagaatttcaaaactactcatacaaaagataggttcaactctgtgagttgaatgctcccatcacaaagaagttcttcagagtgcttctgtgtagtttttatgtgaagatatttccttttccacaataggtctcaaagtactccaaatatccacttgcagattctgcaaaaagagtgtttcaaaactgcccaatcaaaagaaagtttcaactgtgtgagatgaatgcacatatcacaaggaagtttctcagaatgtttctgtgtaatttttatatgaagatatttccttttccacaacacgcttcaaagcgctccaaatatccacatgtagattctacaaaaagagtgtttcaaaactgctcaatcaaaagaaaggttaagctttgtgagatgaaggcacacaacacgaagaagtttctaagaatgcttctgtgtagtttttatttgaagatatttccttttccaccacaggcctaaaagagccacaaatatccacttgcatatcctacaaaaagactgtttccaaactgctcaatcaaaagaaacgttaaaatctatgagatgaatgcacacatggcaaagaagttggtcagaatgattctgtgtagttttaagttgaagatatttccttttccacaaaaggcctcaaaggcctcaaaatatacacctgcagattctacaaacagattttctctaactgctcaatcaagttaaaggctaaactctgtgagatgaatgaacacataacaaggaaatttctcagaatgctttgtgtagtttttatgtgaagatatttccttttcatgcacaggccacaaagctctccaaatatccaattgcagattctataaaaagagagtttcaaaactgctcattcaaaagataggttcaacactctgagttcaatgctcacatcacaaacaagtttatcagagtgcttctgtgtagttttaatgtgaagagatttccttttccaccataggcctcaaagcactccaaatatccacttgcagattctacaaaaacagtgtttacaaactactcagtcaaaagaaagtttcaacactgtgagatgaatgcacacatcacaaagaagtttctcagaatgcttctatgtagtttttatatgacggtatttccttttccacaataggcctgaaagtaatccaaatatccaattccagattctacaaaaagagtttttctgctcagtcaaaagaaaggctcaactgtgagagatgaatgcacacatcaaaaagaagtttttcagaatgcttctgcgtaatttttatgtgaagataattccttttccaccataggcctcaaagggctcccaatttccacctgcagattctacaaaaagagagattcaaaactgctgaatcaacagatatgttcaactctgtgagttgaatgcagacatgacaaagaagtttttccgaatgcttctttgtagtttttatgtgaagatatttccttttccgctatagtcctcaaagtgctccaaatatccaattgcagattctaaaaaaagggtgtttcagaactgttcaatgaaatcaaatgttcaacactgtgagatgaatgtgcacatcacaaagaagtttctcagaatgcttctgtctagtttttatgtgaagatatttccttttacaccataggcctcaaagccctcccaatatccacttgccgattctacaaaaagagtgtttcgaaactgctgaatcaatagaaagtttcaactctgtgagatgaatgcacacatcgcaaggaagtttctcagaatgcctctgtatagtttttatgtgaagatatttccttttccacaataggcctcaaagagcttcaaatatccacttgcagattctataaaaagagtgtttcaaaactgctcaatcaaaagaaaggttcacctccatgagatgattgcacacatcacaaagaagcttctcagaatgcttctgtgtagtttttatgtgaagatatttccttttgcaaaacaggctgcaaagagctcctaatatccacttgcagattctacaaaaagggagattcaaaactgctcaatcaaaagataggttcaactctgtgagttgaatgcatgcatcacatagaagtttctcagaatgcttctgtgtagttttatgtgaacatatttccctttccacagtaggcctcacagggcttcaaatatccacttccaaattctgccaaaagagtgtttaataactgctcaatcaaaagaaagtttcaactatgtgagatgaattcacacatcagaaagtagtttcttagaatgcttctgtgttttgatgtgaagatatttccttttcaaaaataggttgcaaagggctccaaatatccacttgcagatactacaaacagagagtttcaaaaccgctgtatcaaaagaaaggttcaactctgtgagttgaatgcacacatcacaaagaagtttctcagaatgcttctttgtagtttttatatgaagatatttccttttccaccgtaggcctcaaagcgcttcaaatatccacttgcagatcctacaaaaagaatgtttcaaaattgctcaatcaaaagaaagtttcaactcggtgagatgagtgcacgcatcacaaagatgtctctcagaatgcttctgtgtagtttttatgtgaagatattcccttttccacaataggcctcaaagcgcttcaaatatctacttgcagatccttccaaaagagtatttccaaactgctcaatcaaaggaaaggttcaattctatgagatgaatgcacatatcacaaagaagtttctcagaatgcttctatatactttttattcgaagatatttcctattccacagtagtcctgtaagctctccaaatatccacttgcagattgcacaaaaagagtgtttcaagactgctcaatcaaaagagaggttcaactctttcaggtgaatgcacacaacacaaagaagtttctgagaatccttctgtggactttttatttgaagatatatccttttccaccacacgccacaaagggctgaaaatatgcacttgcagattctacaaaaagagagtttcaaaactggtctatcaaaagataggttcaggtgtgtgggtggaatggacacatccaaagaactttctcagaatgcttctgtgtagtttttttgtgaagatatttccttttcaacaataggcctcaaagcgccccaagtatccagttgcagattctacaaaaagatagattaagaagtactcaatccaaacataggttcaattctgtaagatgaatgcacacatcgcaaagaagtttctcagaatgcttctgtatattgtttatgtgaagatatttccttttccacagtaggcctcaaagtgctccaaatatccacttgcagatgctacaaaaagagtgtttcaaaactgctcaatcgaaacgaaggttcaacagtgtgagatgaatgcacatcaaaaagaagtttctcagaatgcttctgtgtagttttatgtgaatatatttccctttccacaataagcctcacagggcttcaaatatccacttccagattcgataaaaagagtggttcacaactgctcaatcaaaagaaagtttcaattctgtgagatgaattcacacatcagaaagtagtttctcaaaatgcttctgtgtaatttttatgtgaagatatttccttttccaccataggctgcaaagggctccaaatatccacttgcctatactataaaaagagagtttcaaaaattctctatcaaaacaaaggttcaacacagtgagttgaatgcacacatcacaaagtagtttctcagaattcttctttgtagtttttatgtgaagatatttccttttccaccattggcttcaaagtgctccaaatatccacttgcagatgctacaaaaagagtgtttgaaaatagatcaattgaaagaaaagttcaactctgtgagatgaatgcacacatcaaaaagaagtttctcagaatgcttctgtgtagtttttatgtgaagatatttccttttccacaataggcctcaaagcacttcaaatacctactagcagattcttcaaaaagagtctttctaaactgctgcatcaaaagaaagtttcagatttttgagatgaatgcacacatcacacagaagtttctcagaatgctttcgtgtagtttttatttgaagatatttccttttcaaaaataggcagcaaagggatcaaaatatccacttgcagattctacaaaaagagaaattcaaaaccgtgccatcaaaggataggttcaactctgtgagtcaaattgacacatcacaaagtagtgtctcagaatacttctgtttagtttttatgtgaagatattcccttttccaacatagacctcaaagtgctctaaatatccaattacagattctacaaaaagagtgtttccaaactgctcaatgaaaagaaagtttcaactctgtgagatgaatgcacatatcacaaagaagtttttcagaatgcttctatatactttttatgcaaagatatttcttattccacagttgtcctctaagctctccaaatatccacttgcagactctacaaaaagagtgtttcaagactgctcaatcaaaagaaaggttcaactctattaggtgaatgcacacaacacaaagatgtttctgagaatccttctgtggactttgtatgtgaagatatttccttttccaccatatgccgcaaagggatgaaaatatgcacttgcagattctacaaaaagagagtttcaaaactggtctatcaaaagataggttcaggtgtgtgggtggaatggacacatcacaaagaactttctcagaatgcttctgtgtagtttttttctgaagatatttccttttcaacaataggcctcaaagcgccctaagtatccacttgcagattctacaaaaagatagattaaaaagggctcaatcaaaagatagattcaattctgtaagatgaatgcacacatcacaaagaagtttctcagaatgcttctgtatgttgtttatgtgaaggtatttcctgttctgcagtaggcctcaaagtgctccaaatatccacttgcagattctacaaaaagagtgtttcaaaactgctcagtcaaaagaaaaattcaattctgtgagatgaatgcacacgtcacaaagaagtttctcagaatgcttctgtgtagtttttatgtgaagatattcccttttccaccataggccacaaagggctccaaatatacacttgcagattctacacagtttcaaaactgctctatagaaagataggttcagttctgtgagttcaatgtacatataacaaagaagtttctaagagtgcttctgtgtagtttttatgtgaagatatttctttttctgctatagggctcaaagcactccaaatatccacttgcagattctacagaaagagtgtttccaaactgctcaataaaaagaaatgttcaaatatgtgagatgaatgcacacatcacaaagaagtttctcagaatgcttctgtgtggtttttatctgaagatatttccttttccacaaatggccttaaagcgttccaaatatccccttgcagattctacaaaaagagtgtttccaaactgctcaataaaatgagaggcttaactctgtgagatgaatctacacatcacaaagctgtttctcagaatgcttcttagtagtttttatttgaagatatttccttttccatcctagtccacaaagggctccaagtatccacttgaagatgctacaaaaagagagttttgaaactgctcaatcaaaagataggttcaaatctgtgagttgaatgcagacatcacaaagaagtttctcggtattcttctgtgtagtttttatgcgaagatatttctttttccacgatagtcatcaaattgcttcgaatatccacttgctgattccagaaaaagagtgtttcaaaagtgcataatcaaaagagagtttgaactctgtgagatgaatgcacagatcacaaacaagtttctcagaatgcttctgtgtactttttatgtgaagatattaccttctccaccataggcctcaaagtgctccaaatatctacttgcagattcttcaaaaagagtgtttccaaactgctgaatgaaaagaaaggttcaactctgtgagatgaatgcacacataacaaagaagattctcagaatgcttctgtgtagtttttatgtgaagttatttccttttccagcataggcctcaaaacactccaaatatccacttgcagattctacaaaaagagtgtttccaaactgctcaatcaaaatgaaggttctactctgtgagaggaacgcacccattgcaaagaagtttctcagaatgcttctgtgtagtttttatgtgaagatatttccttttccatcataggccaaaaagggctccatgtatccacttgaaggtgctataaaaagatagtttcgaaactgctccatcaaaagatatgttcaaatttctgtgttgaatgcacacatcacaaagaagtatcttggaattcttctgtgtaggttttatgtgaagatatttcctttcccaccattggcgtcaaaatgctccgaatatccacttgcagattccacaaaaagagggtttcaaaagtgcacaatcgaaagagaggttcaactctgtgagatgaatgcacacatcacaaacaagtttctcagaatgcttctgtgtactttttatgtgaagatatttccttttccaaaataggcctcaaagcgctccaaatatccatctgcaggttctacaaaaagtctgtttcaaaactgctcaatcaaaagacagtttcaactctctgaggtgaatgcacacatcacaaagaagattctcagaatgcttctgtgtagtttttatgtgaaaatttttccttttccatcataggccacaaagcgctccaaatatccacttgcagattctacaaaaagagtgtttcaaaactgctcaatcaaaggagaggttgaactctgtgagatgaatgcacacatcacaaagaagtttctcagaatgcttctgtgtagtttttctatgaagatattcctttttccaccataggcttcaaagggctccaaatatccacttgaagattttacaaaaagagagtttcaaaactgctctatcaaaaggtaggttcaactctgtgaattgaatgcatacatcacaaagtagttcctcagaatgcttctgggtagtttctatgtgaagatatttccttttccaccataggcctcaaagagctccatatatccacttgcagattctacaaaaagagtgtttccagactgctcaataaaatgaaaggctcaactctgtgagatgaattcacacatcacaaagaaatttgtcagaatgtttctgtgtcgtttttatgtgaagatatttcctttttcatcgtaggccacaaatggctccatgtgtccatttgaagatgctacaaaaagagagttttgaaactgctggatcaaaagataagttcaaatttgtgagttggatgcacacatcacaatgaagtatctcggaattcttctgtgcaggttttttgtgacgctatatccttttccaccataggcgtcaaattgctccgaatatccacttgcagattccacaaaaagagggtttcaaaagtgcacaatcaaaacagaggttcaactctgtgagatgaatgcacacatcacaaacaagtttctcagaatacttctgtgtactttttatgtgaagatatttccttttccaaaacaggactcaaagtgctccaaatatccacctgcaggttctacaaaaagtctgtttcaaacctgctcaaccaaaggcggttcaactctctgagatgaatgcacacatcacaaagaagtttctcagaatgcttctgtgtagtttttgtgtgaagatatttccttttccactctgggcatcaaagggcttcaaatatccacttgcagatcctatcaaaagagtgtttcaaaactgctcaatcaaaagaaagtttaaactctgtgagatgaatgcacacatcacaaaggagtttctcagagtgcttctgtttattttttatgtgaagatatttccttttccacaatagaccttgatgcgatctgaatatccactttcaaattctacaagaagggtgtttcaaaactgctcaatcaaataaaagtttcagctctatgagatgaatgcacacatcacaaggaagttcctcagaatgcttctgtgtagtttttttgtgaagatatttccttttcaaaaatagaccacaaagggctcaaaatatccggttctatattctgcagaaacagaaatacaaaactgttcaatcaaacgacaggttcaactctgtgagttgagtgcacacatcacacagaagtttctcagagtgcttctgtgtagttttcatgtgaagatatttcctcttccaccataggcttcaaagcgctccaaatatacacttgcagattctacaaaaagagtgtttccaaactgctcaatcaagagaaaggttcaactctgtgagatgagtgcacacatcacaaagaagttgtcagaatgcttctgtgtagtttttatgtgaagatatttccttttccacaataggccccaaagtgctgtaaatatccccttgcagattctacaaaaagagtgttacaaaactgctcaataaaatgaaagactcaactctgtgagatgaattcacacatcacaaagaagtttctcagaatgcttctgtgtagtttttatgtgaagatatttccttttccatcataggccacaaagggctccatgtatccacttgaagatgctacaaaaatagagttttgaaactgcttgatcaaaagataggttcaaatttgcgagttgaatgcacacatcacaatgaagtatctcggaattcttctgtgtagtttttttgtgaagatatttccttttccatcataggcttcgaagcgctccaaatatccacttgcagattccacaaaaagagggtttcaaaagtgcacaatcaaaagagaggttcaattccgtgagatgaatgcacacatcacaaacaagtttcttagaatgtttctgcatactttttatgtgaagatatttccttctccaccataggcctcaaagggctccaattatccacttgcagattcttcaaaaactgtgatgtgaatgcacacatcacaaagaagattctgagaaagtttctgtgtagtttttatgtgaagatatttccttttccaccataggcttcaaagcactccaaatatccacttgcagattctacaaaaagagagtttcaaaacttctctatcaaagtagagactcaacgcagtgagttgaatgcacacattacacagaagtttctcagaatgcttctgtgcagtttttatgtgaatatatttccttttccaccagaggcctgaaagtgcttcaaatatctaatttgcagtttctacaaaaagagtttttcaaaactgctcaatcaaaagaaagtttcaactctttcagatgaatgcacagatcacaaagaagtttctcagaatgcttctgtgtagtttttatgtgaagatatttccttttccaccataggcctcaaagcgctccaaatatctatttgcagattctacaaaaagagtgtttccaaactgctcaatccaaagaaaactccaactctctgagatgaatgcacacatcacaaagaagtttctgagaacacttctgcgtaattttaatgtgaagatattccctttccacaataggcctcaaagtgcttcaaatatccacttgcagattttataaagtgtgtttcaaaactgctcaagcaaaagaagggttcaacactatgagatgaatgcacacatcacaaagaagtttctgagaaagctgctgtatagtttttttgtgaagatatttccttttccaaaataggccacaagtggctccaaatgtccacttgcagattctaccaaaagagagatgcaaaactgttctatcaaaaggacagttcaactctccgagttgagtgcacacatcacaaagtagtttctgggaatgcttctatctcgttttatatgaagatattcccgtttccactgtaggccacatagtgctcaaaatatccacttgcagattctataaaaagagtgtttcaaaactgcactatcaaaaggagcgttcaactctgtgagttgaatgcaaacatcacaaagaagtttctgagaatacttctttctagtttctatgtgaaaatatttgtgttcccactgatgccttccttgcgatcaaatatccacctgcagatattacaaaatgagtgtttcaaaactgctctatcaaaaggatggttcaactctctgagttgaatgcacacatcacaaagaagtttctgagaatgcttctgtctagtttttatgtgaagatattcccgtttccaccgtaggcctcaaagagcttaaattatccacttgtagattgtacaaaaagagtgtttcaaaactgctctatcaaaagaaagttcaacactgtgagttgaatgaacacatcccaaagaagtttctgagaatgcctctgtctaatttttatgtgaagatattctcgtttccaccgaaggcctcaaagcggtccaaatatccacttgcagattctacaaaaagagtgtttcaaaactgctcaatcaaaaggattgttcaactctgtgagttaaacccaaacatcacaacatagtttctgagaatgcttctgtgtagtttttatatgaatatatttccttttgtaccataggcctcaaagcactccaaatatccagttgcagattctacaaaaagtgtgtttcaaaactgctctaaaaaaatggaggttaaactctctgaattgaatgcacacatcacaaagaagtttctgataatgcttctgtctagtttttatgtgaagatataccggtttccactgtaggcctaaaagcactccaaatatccacttgcagattctacaaaaagaggcattcaaaactgatctatcaaaaggaaggttcaactctctgagttgaaagcacacatcacaagaagttactgagaatgcttctatctagtttctatgggacgatatttccttttccagcacacgccacaaagcgctccaaatgtccacttgcatattctacaaaaagagtgtttcaagactgctctatcaaaaggaaggttcaactccatgagttgaattcacacgtcacaaagaagtttcagagaatgcttctgtctagtttttatgtgaagatattcccatttccaccataggcctcaaagcgctccaaatatccagttgaaccttctacaaaaagagtgtttcaaaactgctctatcaaaagcaatgctcaagtctgtgagttgaatgcacacatcacaaagaagtttctgagaatgcttctgtctagtttttatgtgaagatatttccctttccaccacaggcctcaaagcgctgcaaacgtccacttgcagattctacaaaaagagtgtttcaaaactgctctatcaaaagaaaggttctactctttgagttgaatgcacacgtcacaatgaagtttctgagaatgcttctgtctaatttttaggtgaggattttcccatttccaacaaaggcctcaaagcgctccaaatgtccacttgcagattctataaaaagagtgtttcaaaagtgctttatgaaaaggaatattcaactctgtgagttgaatgcccacatcaaaatgaagtttctgagaatgcttctgtctagtttttaagtggagatattcgtctttccaccgaaggcctaaaagcgctccgtatatccatctacagattctacaaagagagtgtttcaaaactgctctatcaaaagaaaggttcaactctgggatttgaatgcacacatcacaaagtagtttctgagaatgcttctgtgtagtttttatataaaggtatttccttttctaccataggcatcaaagcactccatatatccacttgcagattctacaacaagatttttcaaagctgctctgccaaaaggaaggtttaactccctgagttgaatgcaagcatcacaaattactttctgaaaatgcttctgtctagtttttctgtgaagatattcccgtttccacgtaggcctcaaaatctccaaatatatacttgcagattctacaaaaagcctctgtcaaaactgctgtatcaaaaggaaggttcaactctcccaggtgaatggacaaatcacaaataagtttctgagaatgcttctgtctagttttcttgtgaagatattactgtttccaccgtaggcctcaaatcgctccaaatatcaaactgcagattccacaaaacgagtgtctcaaaactgcactatgaaaacgaaggttcaaatctgtgagttgaatgcacacatccgaaagaagtttctgagaatgcttccttctagtttttatgtgaagatattccctattacccctaaggcctaaaagcggtccaaatatcctcttgcagattctacaaaaagagtgtttcaaaactgctctatgaaaaggaatgttcagctctgtgagttcaatgcaaacatcacaaagaagtttctgagaatgcttctgtctagtttttgtttgcagacatttccttttccaccatagacctcaaactgctccaaatattcacttgcagattctaaaatagagtgtttcaaaactgctctaagaaaaggaaatttcaactctgtgagttgaatgcacacatcacaaagaagatactgagattgcctctgtccagtttacatgtgaagatatacccctttccaccaaaggcctaaaagcactccaaatatccacttgcagattctacaaaaagagtgtttcaaaactgatctatcaaaaggaagtgttatcttcatgaggtcaatgcacatcacaatatagtttctgataatgcttctgtataatttttatatgaagatatgtccttttccaacataggcctcaaagggctcaaaatatccacttgcagattctatgaaaagagtgattcaaaactgctctatgaaaaggaaggttgaactccgtgagttgaatgcacccatcacaaagaaggttctcagaatgaagatattacgtgaagatattcttgtttccaccgaaggcctcaaagtgctccaaatatccacttgccgatcctacaaaaagagtgtttcaaaactgctctatcaaaagaaaagttcaactcttttagttgaatgcacacttcacaaagaagtttctgagaatgcttctgtctactctttaggtgaagaaacttccttttccatcatagaccttaaagcgctcaaatatccacttgcagattcttcaaaaagagtgtttcaaaactgctgtatgaaaagggaggtccaattctgtgagttgaatgcacacatcacaaagaagtttctaggatacttctgtcaagattttatgtgaagatattcccgtttccaacataggcctcaaagagctccaaatatccacttgcagattctacaaaaatagtgtttcaaaactgctctatcaaaagaaaggttcacctctgtttgttgaacgaacacataacaaagaaatttctgagaatccatctgtctactttttatgtgaagacacttccttttccaccatagacctcaaagcgctccaaatatccaattccagattctacaaaaagagtgtttcaaaactactctatcaaaacgaaggttaaactctgtgagttgaatgcacacatcacaaagaagtttctgagaatgcttcggtctgatttttatgtgaagttatttcccttttcaccacaggcatcaaagtgctcaaaatgtccaattgcagattctacaaaaagagtttttcaaaacttgtctatgaaaagaaaggttcaactctgtaggttggatgcacacatcacaaagtagtttctgagaatgcttctgtctagtttttaatatgaagacatttccttttctaccttaggcctcaaagcgctccaaatatccacttgcagattccacaaaaagagtgtttcaaaactgatctatgaaaaggaagtttctactctgtgaattgaatgcgcacaacacaaagaagtttccgagactgtttctgtctagtttttatatgaagatattccagtttccagagaaggcctcaaagagttccatatatccacttgcagattctacaaaaagagtgtttcaaaactgctctgtgaaaaggaatgttcagcactgtgagtggaatggaaacatcacaaagaagtttctgagaatgctgctgtctagtttttatgtgaaaatattcccgtttccaccaaaggcctcaaagcggtccaaatatccacttacagattctacgaagagtgtttcaaaactgctctatgaaaaggtatgttcaactctgtgagtagaatgcaaacatcacaaagagatttctgagaatgcttctgtctggtttttatgtgaagatattcccgtttccagtgaaggcctcaaagccgtccaaatatccacctgcagatactatgaaaagagtgtttcaaaactgctctatgaaaaggtatgttcaactctgtgagtagaatgcaaacatcacaaagagatttctgagaatgcttctgtctagtttttatgtgaagatattcccgtttccaatgaaggcctcaaagccatccaaatatccacctgcagatactatgaaaagagtgtttcaaaactgctctatgaaaaggtatgttcaactctgtgagttgaatgcaaacatcacagagaagtttctgagaatgcttctgtctagtttttttttttttttggaatgataaacattttaatttgaaaagcaggcatctctgctgttaagctttcttttgatgggtggggagtggggggcgttggagtttatttatttttgttattattatacttcaagttttagtgtacatgttcacaatgtgcaggttagttacgtatgtatacatgtgccatgctggtgtgctgcacccactaactcgtcctctagcattaggtatatctcccaatgccatccttctcccctcccctcaccccacaacagtccccagagtgtgatgttccacttcctgtgtccatgtgatctcattgttcaattcccacctatgagtgagaatatgcggtgtttggtttcttttcttgcgatagtttactgagaatgatgatttccaatttcatccatgtccctacaaacgacatgaactcatcatttttatggttgcatagtattccatggtgtatgtgtgccacattttcttaatccagtctatcattgttggacatttgtgttggttccaagtctttgctattgtgaatagtgccacaataaacatacatgtgcatgtttctttatagcagcatgatttatagtcctttgggtatatacccagtaattggatggctgggtcaaatggtatttctagtcctagatccctgaggaatccccacacggagttccacaatggatgaactagtttacagtcccaccaacagtgtaaaagtgttcctatttctccacatcctctccagcacctgttgtttcttgactttttaatgattgccattgtaactggtgtgagatggtatctcattgcggttttgatttgcatttctctgatggccagtgagggtgagcattttttcatgtgttttttggcagcataaatgtcttcttttgagaagtgtcagttcatgtcctttgcccactttttgatggggttgtttgtttttttcttgtaaatttgtttgagttcattgtagattctggatattagctctttgtcagatgagtaggttgtgaaaattttctcccattttgtagtttgcctgttcattctgatggtaatttcttttgcagtgcagaagctctttagtttagttagatcccatttgtcaattttggcttttattggcactgcttttggtgttttagacatgaagtccttgaccatgcctatgtcctgaatggtaatgcctaggatttcttctagggttttcatggttttacatctaatgtttaagtctttaatccatcttgaattgatttttgtataaggtataaggaagggatccagtttcagctttctacataaggctagccagttttcccagcaccatttgttaaatagggaatcctttccctattgcttgttcttctcaggtttgtcaaagatcagatagttgtagatatgtggcgttatttctgagggctctgttctgttccattgatctatatctctgttttggtaccagtaccatgctgttttggttactgtagccttgcagtatagtttgaagtcaggtagtgtgatgcctccagctttgttctttaggcctaggattgtcttggtgatgcgggctattttttgattcctatgaactttaaagtagtttttcctattctatgaagaaagtgattggtagcttgatggggttggcattgaatctgtaaattaccttgggcagtatggccatttccacgatattgattcttcctacccatgagcatggaatgttcttccatttgtttgtatcctattttatttccttgagcagtggtttgtagttctccttgaagaggtctttcacgtcccttgtaagttggattcctaggtattttattctcttggaaacaactgtgaatgggagttaagtcatgatttggctctctgtttgtctgttgttggtgtataagaatgcttgtggtttttgcacattgattttgtatcctgagactttgctgaagttgcttatcagcttaaggagattttcggctgagacaatggggttttctagatatacaatcatgtcatctgcaaactgggacaatttgacttcctctttatctaattgaataccctttatttcattctcctgcttaatcgccctggccagaacttccaacactatgttgaataggagtggtgagagagggcatccctctcttgtgccagttttcaaagggaatgcttccagtttttgcccattcagtatgatattgtctgtgggtttgtcatagatagctcttattattttgaaatgcatcccatcaatacctaatttattgagagtttttagcatgaaggattgttgaattttgtcaaatgccttttctgcgtctattgagataatcatgagtttttttctttggttctgtttatatgctggattacatttattgatttgcatatattgaaccagccttgcatcccagggatgatcccagcccacttgatcatggtggataagctttttgatgtgctgctggattcggtttgccagtattttattgaggatttttgcatcaatgttcatcaaggatattggtctaaaattctcttttttgattgtgtctgcccggctttggaatcagaatgatgctggcctcataaaatgagttagggaggattccctcgttttctattgattggaatagtttcagaaggaatggtaccagctcctccttgtacctttggtagaattcggctgtgaatccgtctggtcctggactctttttggttggtaagctattgattattgccacaatttcagatcctgttattggtctattcagagattcaacttcttcctggtttagtcttgggagagtgtatgtgtcgaggaatttatccatttcatctagattttccagtttatttgcatagaggtgtgtgtagtattctctgatggtagtttgtatttctgtggaatcggtggtgatatcccctttatcattttttattgcatctatttgattcttctctctttttttctttttagtcttgctagtggtgtatcaattttgttgacccttcaaaaaaccagctcctggatccattaattttttgaagggttttttgtgtctccatttccttcagttctgctctgattttagttatttcttgccttctgctagattttgaatgtgttttctcttgcttttttagttcttttaattgtgatgttagggtgtcaattttggatctttcctgctttctcttgtgggcatttagtgctgtaaatttccctctacccactgctttgaatgagtcccagagattctggtatgttgtgtctttgttctcgttggtttcaaggaacatgtttctttctgccttcatttcgttatgtacccagtagtcactcaggagcaggttgctcagtttccatgtagttgagtggtttgagtgagattcttaatcctgagttctagtttgattgcactgtggtctgagagagagtttgttataatttctgttcttttacatttgctgaggagagctttacttccaagtatgtggtacattttgaaataggtgtggtgtggtgctgaaaaaaatgtatattctgttgatatggggtggaaagttctgtagatgtctattaagtccgcttggtgcagagctgagttcaattcctggatatccttgttgactttctgtctagttgatctgtctaatgttgacagtggggtgttaaagtctcccatttttaatgtgtgggagtctaagtctctttgtaggtcactcaggacttgctttatgaatctgggtgctcctgtattgggtgcatatatatttaggataattagctcttcttgttgaattgatccctttaccattatgtaatggccttctttgtctctttttatctttgttggtttaaagtctgttttatcagagactagcattgcaacccctgccttttttgttttccattttcttggtagatcttcctccatcctttcattttgagcctatgtgtgtctctgcacgtgagatgggtttcctgaatgcagcacactgatgggtcttgattctttatccaatatgccagtctgtcttttaattgcagcatttagttcatttacatttaaagttaatattgttgtgtgtgaatctgatcctgtcattatgatgttagctagttatcttgctcgttaattgatgcagtttcttcctagtctcaatggtctttacattttggcatgattttgcagtggctggtactggttgttcctttccatgtttagtgcttccttcaggagcttttttagggcaggcctggtggtgacaaaatctctcagcatttgcttttctgtgaagtattttatttatccttcacttaggaagcttagtttggctggatatgaaattctgggttgaaaattcttttctttaagaatgttgaatattggcccccactctcttctggcttgtggggtttctgccaagagatccactgttagtctgatgggcctccctttgagggtaacccaacctttctctctggctgcccttaacattttttccttcatttcaactttgcggaatctgacaattatgtgtcttggagttgctcttctcgagtatctttgtggtgttctctgtatttcctgaatctgaatgttggcctgccttgttagattggggaagttctcctggataatatcctgcagagtgttccaacttggttccattctccccatcattttcagatacaccaaacagatgtagatttggtcttttcacatagtcccgtatttcctggaggatttgctcatttctttttattcttttttctctaaacttcccttctcacttcatttcattcatttcatcttccatcgctgataccctttcttccagttgattccattgtctcctgaggcttct

SEQ ID NO: 12844 - DNA, 6037 bp, Homo sapiens
tctttcttttttttttttttaattatactttaagttttagggtacatgtgcacattgtgcaggttagttacatatgtatatatgtgccatgctggtgcactgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatgttttccaatttcatccatgtccctacaaaggacatgaactcatcattttttatggctgcatagtactccatggtgtatatgtgccacattttcttaatccagtctatcattgttggacatttgggttggttccaagtctttgctattgtgaataataccgcaataaacatacgtgtgcatgtgtctttatagcagcatgatttatagtcctttgggtatatacccattaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgaatttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagtcttgtagtatagtttgaagtcaggtagtgtgatgcctccagctttgttcttttggcttaggattgacttggcgatgcgggctcttttttggttccatatgaactttaaagtagttttttccagttctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttttacattgattttgtatcctgagactttgctggagttgcttatcagcttaaggagattttgggctgagacaatggggttttctagatatacaatcatgtcatctgcaaatagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttttgttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttccagattttctagtttatttgtgtagaggtgtttgtagtattctctgatggtagtttgtatttctgtgggatcggtggtaatatcccctttatcattttttttattgtgtctattagattcttctctctttttttctttattagtcttgctagcggtctatcaattttgttgatcctttcaaaaacccagctcctggattcattaattctttgaagggttttttgtgtctctatttccttcagttctgctctgatcttagttatttcttgccttctgctagcttttgaatttgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttctaatttctgttcttttccatttgctgatgagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtatctttgtagatcactcaggacttgctttatgaatcttggtgctcctgtattgggtgcatatatatttaggatagttagctcttcttgttgaattgatccctttaccattatgtaatggtcttctttgtctcttttgatctttgttggtttaaagtctgttttatcagaggctaggattgcaacccctgcttttttttgttttccatttgcttggtagatcttcctccatccttttattttgagcctatgtgtgtctctgcacgtgagatgggtttactgaatacagcatactgatgggtcttgactctttatccaatttgccagtctgtgtctttcaattggagcatttagtccatttacatttaaagttaatattgttatgtgtgactttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctcctttgcttatgacgcttagtttggctggatatgaaattctgggttgaaaattcttttccttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcggacgtagatttggtcttttcacatagtcccatatttcttggaggctttgctcatttctttttattcttttttctctaaacttcccttctcgcttcatttcattcatttcatcttccatggctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggatgtcctttctgtatgttagttttccttctaacagacaggaccctcagctgcaggtctgttggaataccctgccatgtgaggtgtcagtgtgcccctgctggggggtgcctcccagttaggctgctcaggggtcaggggtcagggacccacttgaggaggcagtctgcccgttctcagatctccagctgtgtgctgggagaaccactgctctcttcaaagctgtcagacagggacatttaagtctgcagaggttactgctatctttttgtttgtctgtgccctgtcctcagaggtggagcctacagaggcaggcaggcctccttgagctgtggtgggctccacccagttcgagcttcccgctgctttgtttacctaagcaagcctgggcaatggcgggcgcccctcccccagcctggctgctgccttgcagtttgatctcagactgctgtgctagcagtcagcgagactccgtgggcgtaggaccctccgagccaggtgcgggatataatctcgtggtgtgccgttttttaagcccgtcggaaaagggcagtattcaggtgagagtgacccgattttccaggtgccgtccatcacccctttctttgacttggaaagggaactccttgaccccttgtgcttcccaagtgaggcaatgcctcgccctgcttcggctcgcgcacggtgcgcgcacccactgacctgcgcccactgtctggcactccctagagaaatgaacccggtacctcagatggaaatgcagaaaacactgtcttctgcgtcgctcacgctgggagctgtagaccggagctgttcctattcggccatcctggctcccc

SEQ ID NO: 12845 - DNA, 6064 bp, Homo sapiens
ttctttcctttttttttttcttttttttaaattattatcattatactttaagttttagggtacatgtgcacattgtgcaggttagttacatatgtatacatgtgccatgctggtgcgctgcacccaccaacttgtcatctagcattaggtatatctcccagtgctatccctccccccgccacccgacaacagtccccagagtgtgatgttccccttcctgtgtccatgtgttctcattgttcaattcccacctacgagtgagaatatgtggtgtttggttttttgttcttgtgatagtttactgagaatgatgatttccaatttcatccatgtccctacaaaggacatgaactcatcgttttttatggctgcatagtattccatggtgtatacgtgccacattttcttaatccagtctatcactgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcacgtccttcgcccactttttgatggggttgtttgtttttttcttgtaaatttgtttgagttctttgtagattctggatattagccctttgtcagatgagtaggttgtgaaaattttctcccattttgtaggttgcctgttcactctgatgttagtttcttttgctgtgcagaagctctttagtttaatcagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttaataaatagggaatcctttccccattgcttgtttttcccaggtttgtcaaagatcagatagttgtagatatgcggcgttatttctgagggctctgttctgttccattgatctatatctctgttttggtaccagtaccgtgctgttttggttactgtagccttgtagtatagtttgaagtcaggtagtgtgatgcctccagctttgttcttttgtcttaggattgacttggtgatgcgggctcttttttggttccatatgaactttaaagtagttttttccaattctgtgaagaaaggcattggtagcttgatgggcatggcattgaatctgtaaattaccttgggcagtatggccattttcacaatattgattcttcctacccatgagcatggaatgttcttccatttgtttgtatcctctttcatttccttgagcagtggtttatagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagtttaaggagattttgggctgagactatggggttttctagatatacaatcatgtcgtctgcaaacagggacaatttgacttcctcttttcctaactgaataccctttatttccttctcctgcctaattgccctggccagaacttccaacactatgttgaataggagtggtgaggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcacctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattgttctaaaattctctttttttgttgtgtctctgcctggctttggtatcagaatgatgctggcctcataaaatgagttagggaggattccctctttttctattgattggaatattttcagaaggaatggtaccagttcctccttgtacctctggtagaattcggctgtgaatccatctggtcctggactctttttggttggtaagctattgattattgccacaatttcagatcctgttattggtctattcagagattcaatttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcatctatttgatttttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagctttggaatgtgtttgctcttgcttttctagttcttttaattgtgatgttagggtgtaaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtgcccagtagtcattcaggagcaggttgttcagtttccatgtagttgagcggctttgagtgagattcttaatcctgagttctagtttgattgcactgtggtctgagagatagtttgttataatttctgttcttttccatttgctgaggagtgctttacttccaagtatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtagatcactcaggacttgctttatgaatcttggtgctcctgtattgggtgcatatatatttaggatagttagctcttcttgttgaattgatccctttaccattatgtaatggccttcttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtatcctgaatacaggacactgttgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtactggttgttcctttccatgtttagcgcttccttcaggagctcttttagggcaggcctggtggtgacaaaatctctcagcatttgcttgtctgtaaagtattttatttctccttcgcttatgaagtttagtttggctggatatgaaattctgggttgaaaattcttttctttaagaatgttgaatattggcccccactctcttctggcttgtagagtttctgccgagagatcagctgttagtctgatgggcttccctttgagggtaacccgacctttctctctggctgcccttaacattttttccttcatttcaactttggtgaatctgacaattatgtgtcttggagttgctcttctcgaggaatatctttgtggcgttctctgtatttcctgaatctgaacgttggcctgccttgctagattggggaagttctcctggataatatcctgcagaatgttttccaacttggttccattctccccatcactttcaggtacaccaatgagacgtagatttggtcttttcacatagtcccatatttcttggaggctttgctcatttctttttattcttttttctctaaacttcccttctcgcttcatttcattcgtttcatcttcctttgctgatatcctttcttccagttgattgcattggctcctgaggcttctgcattcttcacgtagttctccagccttggttttcagctccatcacctcctttaagcacttctctgtattggttattctagttatacattcttctaaatttttttcaaagttttcaacttctttccctttggtttgaatgtcctcccgtagctcagagtaatttgatcgtctgaagccttcttctctcagctccttaaagtcattctccgtccagctttgttccgttgctggtaaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccttgccgtgtgaggtgtcagtgtgcccctgctggggggtgcctcccagttaggctgctcgggggtcaggggtcagggacccactcgaggaggcagtctgcccgttctccgatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgtgggatataatctcgtggtgcgccgttttttaagcccgtcggaaaagcgcagtattcgggtggggtgacctgattttccaggtgccctcagtcacccctttctttgactcggaaagggaactccctgaccccttgcgcttcccaagtgaggcaatgcctcgccctgcttcggctcgcacacggtgtgcgcacccactgacctgcgcccactgtctggcactccctagtgagatgaactgggtacctcagatggaaatgcagaaatcacccgtcttctgcgtcgctcacgctgggagctgtagaccggagctgttcctattcggccatcttggctcctcctgcttctttcctt

SEQ ID NO: 12846 - DNA, 5786 bp, Homo sapiens
ttttggggttttttgtttttctttttctttttttaattatactttaagttttagggtacatgcgcacattgtgcatgttagttacatatgtatacatgtgccatgctggtgcgctgcacccactaactcatcatctagcattaggtatatctcccaatgctatccctcccccctccccccaccccacaacagtccacagagtgtgatgttccccttcctgtgtccatgtgatctcattgttcaattcccacctatgagtgagaatatgcgtgtttggttttttgttcttgtgatagtttactgagaatgatgatttccaatttcatccatgtccctacaaaggacatgaatttatcattttttatggctgcatagtattccatggtgtatatgtgccacattttcttaatccagtctatcattgttggacatttgggttggttccaagtctttgctattgtgaataatgccacaataaacatacttgtgcatgtgtctttatagcagcatgatttatagtccttcgggtatatacccagtaatgggatggctgggtcaaatggtatttctagttctagatccctgaggaatcgccacactgacttccacaatggttgaactagtttacagtcccaccaacagtgtaaaagtgttcctatttgcccacatcctctccagcacctgttgtttcctgacttttaatgattgccattctaactggtgtgagatggtatctcattgtggttttgatttgcatttctctgatggccagagatgatgagcattttttcatgtgttttttggctgcataaatgtcttcttttgagaagtgtctgtttatatcctttgcccactttttgatggggttgtttgttttttttttttgtaaatttgtttgagttcattgtagattctggatattagccctttgtcagatgagtaggttgagaaaattttctcccattttgtaggttgcctgttcactctgatggtagtttgttttgctgtgcagaaactctttagtttaattagatcccatttgtcaattttggcttttgttgcccattggttttggtgttttcgacatgaagtccttgcccatgcctatgccctgaatggtaatgcctaggttttctcctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagacaattgtagatatgtggcgttatttctgagggctctgttctgtcccatagatctatatctctgttttggtaccagtaccatgctgttttggttactgtagccttgcggtatagtttcaagtcaggtaatgtgatgcctccagctttgttcttctcgcttaggattgacttggtgatgtgggctcctttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttctttcatttgtttgtatcttcttttatttccttgagcagtggtttgtagttctccttgaagaggtccttcacatcccttgtaatttggattcctaggtattttattctctttgaagcaattgtgaatgggagttcactcatgatttggctctctgtttgtctgttgttagtgtataagaatgcttgtgatttttgtacattgattttgtatcctgagactttgctgaagttgcttatcagcttaaggagattttgggctgagacaatggggttttctagatattcaatcatgtcatctgcaaacagggacaatttgacttcctcttttcctaattgagtaccctttattcccttctcctgcctgattgccctggccagaagttccaacactatgttgaataggagtggtgagagagggcatccctgtcttgtgccagttttcaaagggaatgcttccagtttttgcccattcagtatgatattggctgtgggtttgtcatagatagctctgattaatatgagatatgtcccatcaatacctaatttattgagagtttttagcatgaagtgttgttgaattttgtcaaaggccttttctgcatctattgagataatcgtgtggtttttgtctttggctctgtttatatgctggattacatttattgatttgggtatattgaaccagccttgcattccagggatgaaatccacttgatcatgatggattagctttttgatgtgctgctggattctgtttgtcagtgttttattgaggacttttgcatcaatgttcatcaaggatataggtctaaaattctctttttggttgtgtctctgcccggctttggtatcagaatgatgctgacctcataaaatgagttagggaggattccctctttttctattgattggaatagtttcagaaggaatggtaccagttcctccttgtacctctggtagaattcggtgtgaatccatctggtcctggactctttttggttggtaagctattgattattgccacaatttcagatcctgttattggtctattcagagattcaacttcttcctggtttagtcttgggagagtgaatgagtccaggaatttatccatttcttctagattttctagtttatttgcgtagaggtgtttgtagtattctctgatggtagtttgtatttctgtggaatcagtggtgatatcccctttatcattttttattgcatctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaatcgtgatgttaggttgtcaattttggatctttcctgctttctcttgtgggcattaagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcagttttgagtgagattcttaatcttgagttctagtttgattgcactgtggtctgagagatagtttgttataatttctgttcttttacatttgctgaggagaggtttacttccaagtatgtggtcaattttggaataggtgtggtgtggtgctgaaaaaaatgtatattctgttgatttggggtggagagttctgtagatatctattaggtccccttggtgcagaactgagttcaattcctgggtgtccttgttgactttctgtctcgttgatctgtctaatgttgacagtggggtgttaaagtctcccattattaatgtgtgggagtctaagtctctttgtaggtcactcaggacttgctttatgaatctgggtgttcctgtattgggtccatatgtatttagaatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttcattttgagtctatgtgtgtctctgcaggtgagatgggtttcctgaatacagcacactgatgggtcttgactctctatccaatttgccagtctgtgtcttttaattggagcatttagtccatttacatttaaatttaatattgttatgtgtgaatttgatcctgtcattatgatgttagctggttattttgctcattagttgaagcagtttcttcctagtctcgatggtctttacattttggcatgattttgcagcagctggtaccggttgttcctttccatgtttagtgcttccttcgggagctcttttagggcaggcctggtggtgacaaaatctctcagcatttgcttgtctgtaaaggattttatttctccttcacttatgaagcttagtttggctggatatgaaattctgggttgaaaattcttttctttaagattgttgaatattggcccccactctcctctggcttgtagggtttctgcctaaagatctgctgttagtctgatgggcttccctttgagggtaacccgacctttctctctggctgccgttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggtcccattctccccatcactttcaggtacaccaatcagacgtaggtttggtcttttcacatagtcccatatttcttggaggctttgctcatttctttttattcttttttctctaaaattcccttctcacttcatttcattcatttcatcttccattgctgataccctttctttcagatgatcacatcagctcctgaggcttctgcattcttcaggtagttcttgagccttggttttcagctccttcagctcctttaagcacttccttctgtattgattattctagttatacattcttctaaattttttttcaaagttttcaacttctttgcctttggtttgaatgtcctcccgtagctcagagtaatttgatcgtctgaagccttcttctctccgctcatcaaaatcattctccatccacctttgttctgttgctggtgaggaactgcattcctttgcaggaggagaggtgctctgctttttagagtttccagtttttctgttctgttttttccccatctttgtggttttatatctacttttggtcttttatgatggtgatgtaccgatgggtttttggtgtggatgtcctttctgtttgttagttttccttctaacagacaggaccctcagcttcaggtatgttggagtaccctgccgtgtgaggtgtcagtgtgcccctgctggggctgcctcccagttaagctgcttgggggtcaggggtcagggacccacttgaggaggcagtctgcccattctcagatctccagctgtgtgctgggagaaccactgttctcttcaaagctgtcagacagggatatttaagtctgcagaggttactgctgtctttttgtttgtctgtcccctgcccccagaggtggagcctacagaggcaggcaggcctccttgagctgtggtgggctccaccctgttcgagttccccggctgctttgtttacctaagcaagcctgggccatggtgggcgcccctcccccagcctcgctgctgccttgcagtttgatctcagactgctgtgctagcaatcagtgagactctgtgggcgtaggaccctccaagccatgtgtgggatataatctcgtggtgtgccgttttttaagtccgtcggaaaagcgcagtattagggtgtgagtcacc

SEQ ID NO: 12847 - DNA, 6044 bp, Homo sapiens
ttgttttgttttttttttttaatttattattattatactttaagttttagggtacatgtgcacaatgtgcaggttagttacatatgtatacatgtgccatgctggtgtgctgcacccactaactcatcatctagcgttaggtatatctccccatgctatccctccccactttccccaccccacaacagtccccagagtgtgatgttccccttcctgtgtccatgtgttctcattgttcaattcccacctatgagtgagaatatgcggtgttgggttttttgttcttgtgatagtttactgagaatgatgatttccaatttcatccgtgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtcatgtctctttatagcagcatgatttatagtcctttgggtatatacccagtaatgggatggctgggtcaaatggtatttctagttctagatccctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtggtttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtactgcctaggttttcttctagggtttttatggttttaggtctaacatttaagtctttaatccatcttgaattgatttctgtataaggtgtaaggaagggatccagtttcagctttctacatatggctagccagttttcctagcaccatttattaaatagggaatcctttccccattgcttgtttttgtcaggtttgtcaaagatcagatagttgtagatatgcggcattatttctgagggctctgttctgttccattgatctacatctctgttttggtaccggtaccatgctgttttggttactgtagccttgtagtatagtttgaagtcaggtagtgtgatgcctccagctttgttcttttggattaggattgacttggcgatgtgggctcttttttggtttcataggaactttaaagtagttttttccaattctgtgaagaaagtcagtggtagcttgatggggatggcattgaatctataaattaccttgggcagaatggccattttcaagatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttagcagcttaaggagattttgggctaagacaatggagttttctagacatacaatcatgtcatctgcaaacagggacaatttgacttcctcttttcctaattgaataccctttatttccttctcctgcctgattgccctggccagaacttccaacactatgttgaataggagtcgtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttccgcatctattgagataatcatgtggtttttgtctttggttctgtttatatgctggattacatttattgatttgcgtatattgaaccatccttgcatcccagggatgaacccacttgatcatggtggataagctttttgatgtgctgttggattcagtttgccagtattttattgaggatttttgcatcaatgttcatcaaggatattggtctaaaattgtcttttttggttgtgtctctgcccggctttgctatcaggatgatgctggcctcataaaatgagttagggaggattccctctttttctgttgattggaatagtttcagaaggaatggtatcagttcctccttgtacctctggtagaattcagctgtgaatccatctgttcctggactctttttggttggtaaggtattgtttattgccacaatttcagatcctgttattggtctattcagagattcaacttcttcctggtttagtcttgggagagtgtatgtgtcaaggaatttatccatttcttctagattttctggtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtgtcaattttggatctttcctgcttcctcttgtgggcatttagtgctataaatttccctctacacactgctttgaatgcatcccagagattctggtatgttgtgtctttgttctcgttggtttcaaagaacatctttatttctgccttcatttcgttatatacccagtagtcattcaggagcaggttgttcagtttccatgtagttgagcggttttgagtgagtttcttcatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatatggggtggagagttctgtagatgtctattaggtccgcttggtgcagagctgagtccaactcctggatatccttgctaactttctgtctcgttgatctgtctaatgttgacagtggggtgttaaagtctcccattattattgtgtgggagtctaagtctctttgtaggtcgctcaggacttgccttatgaatctgggtgctcctattttgggtgcatatatatttaggatagttagctcttcttgttgaattgatccctttcccattatgtaatggccttctttgtctcttttgatctttgttggtttaaagtctgttttatcagagactaggattgcaacccctgcctttttttgttttccatttgcttcgtagatcttcctctatccttttattttgagcctacgtgtgtctctgcatgtgagatgggtttcctgaatacagcacactgatgggtcatgactctttatccaatttgccagtctgtgtcttttaattggagcatttagtccagttacatttaaaggtaatattgttatgtgtgaatttgatcctgtcattatgatgttagctggttattttgctcattagttcatgcagtttcttcctagtctcgatggtctttacattttggcatgattttgcagcggctggtatcagttgttcctttccatgtttggcacttccttcaggagcacttttagggcaggcctcgtggtgacaaaatctctcagcatttgcttgtctgtaaagtattttatttctccctcacttataaagcttagtttggctggatatgaaattctgggttgaaaattcttttctttaagaatgttgaatattggcccccactctcttctggcttgtagaatttctgctgagagatctgctgtcagtctgatgggcttccctttgtgggtaacccgacctttctctctggctgcccttaacatattttccttcatttcaacttcaatgaatctgacaattatgtgtcttggagttgctcttctcgaggagtagctttgtggcgttctctgtatttctgaatctgaatgttggcctgccttgctagattggggaagttctcctggatgacatcctgcagagtgttttccaacttggttccattctccccatcactttcagttacaccaatcagacgtagatttcgtctttacacgtagtcccatatttcttggaggctttgctcgtttctttttattcttttttctctaaagttcccttcttgcttcatttcattcacttcatcttccatcgctgataccctttcttccagttgatcgcatcggctcctgaggcttctgcattcttcacgtagttctcgagccttggtcttcagctccatcagctcctttaagcacttctctgtattggttattctagttatacattcttctaaacttttctcaaagttttcaacttctttgcctttggtttgaatttcctcctgtagctcggagtaatttgatcatctgaagccttcttctctcagctcgtcaaagtcattctccgtccagctttgttccgttgctggtgatgaattatgttcctttggaggaggagaggcgctctgcgttttagagtttccagtttttctgctctgttttttccccatcttggtggttttatctacttttggtctttgatgatggtgatatacagatgggtttttggtgtggatgtcctttctgttttagttttccttctatctgacaggaccctcagctgcaggtctgttggagtacccagccctgtgaggtgtcagtctgcccctgctggggggtgcctcccagttaggctgctcgggggtcaggggtcagggacccacttgaggaggcagtctgcccgttctcagatctccagctgcgtgctgggagaaacactgctctcttcaaagctgtcagacagggacatttaagtctgcagaggttactgcggtctttttgtttgtgtgtgccctgcccccagaggtggagcctccagaggcaggcaggcctccttgagctgtggtgggctccacccagttggagcttcccggctgctctgtttacctaagcaagcctgggcaatggcgggcgcccctccccaagcctcgctgccaccttgcagtttgatctcagactgctgtgctagcaatcagtgagactccatgggcgtaggaccctccgagccaggtgcgggatataatctcctggtgcggcgttttttaagcccgtcggaaaagcgctgtattcgggtggaagtgacccgattttccaggtgccatctgtcacccctttctttgactaggaaagggaactccctgactctttgcgcttcccgagtgaggcaatgcctcgccctgcttcggctcgtgcatggtgcgcgcacccattgacttgcgcccactgtctggcactccctagtgagatgaacccagtacctcagacgaaaatgcagaaatcacccatcttctgcgtcgctcacgctgggagctgtagaccagagctgttcctattcggccatcttggctcctccc

SEQ ID NO: 12848 - DNA, 492 bp, Homo sapiens
tttttcttataaatctgtttaagttctttgtatagtctggatattagccctttgttgaatggatagattgcaaaaattttctcccattctgtaggttgcctgttcactctgatgatagtttcttttgctgtgcagaagctcgttagtttaattagatcccatttgtcaattttggcttttgttgcaattgcttttggtgttttagtcatgaagtctttgcctatgtctatgtcctgaatggtattgcctaggttttcttctagggtttttatggttttaggtcttacatttaggtccttattcatcttgagttaatctttgtataaggtgtaaggaagaggtccagtttcagttttctgcatatggctagccagttttcccaacaccatttattaaatagggaatcctttccccattgcttgtttttgtcaggtttgtcaaagatcagatggttgtagatatgtagttttatttctgagacctctgttctgt

SEQ ID NO: 12849 - DNA, 872 bp, Homo sapiens
ctgagttcattttaaaaaactgcatgaatcctttctagcagaccagagccacttgttgtcttggggtgatgggcttttacatgtagctggtctttctgtttaaacccaaaggatgggaaagtgcccttgacagctttcagcaaggatctctagcacttacaaaaagggggctttaggggagtcatgccaatctatggaggtcactgggctggaaccgatcaggctttcaacaaaaaaagtgttgatagaaatggacaatgggattccaggtactgaatccatatcattttaaactgtttatctttaggacttggcgcatctgctagagaaaaacagcaaatagcacatctaaaaacagcttggtggttttttgcatctttagagaaagctgctttaggagggtctgcagtatagacctcctgtatctgcaaggtgacagacggaggaccccaagccgtgggaactggtcacctactgtggggcccaggcctctccccactgcaggtcaagcccatcttgaagccaccacctgcttagtgctcaaggtcaccgctctcagcctggtccaggtgctgaaggatcatctcgacacgagggggcgccatctcctcacattgtgaggaagcctctggcatcgggatgaattttgttctagagctttccttctacaaacctcggtgttgttctcgctcacatgcaagaaagaatcggagtattgtgaggtctgcaaatgaaagggtcccttgccaaatgctctaatccaggctcctggtgtttgcgggcccagatagctacagtttgttgtcccctggctgcaaaccttctaggagtttctagctttagaaaccctagaaacaaaccccttctaatgt

SEQ ID NO: 12850 - DNA, 395 bp, Homo sapiens
tcaagtagctgggaccacaggcgcacatcatcacactcggctactttttgtattttttgtagagatgaggtttcatcatattggcaaggctggtcttgaactcgtgagctcaagcgatttacctgcctcagcctcccaaagtgctgggattataaatgtaagccatcatgcttggcctgaaccaattttaacttttaaaaatcaccttttctttgttatacattcaagaagacactgagatgggcattagactaacatcaagctaagttgcatataatttcataaactctgagctttcttgaatatattttttaatttgtgggaattccttgtacacctgagccccaaagacacagcaaactccagtcatagcttggcaattaaatgaagcaatg

SEQ ID NO: 12851 - DNA, 274 bp, Homo sapiens
gaaattaaatacctctgttattgatgaagccatattttaaatattatcaccactaaactcagttaaatatttccactgttaactacaaggttcaaatgcttggatattatagaagatatttgacttcaaagataaacgctacaattttgggtcataacaaatagcttttagaaggggaaaaaataagtcttgggaggaaaataagcagtctcttagtttaatatagcggttggcaaatatagatgcttaaaagttctgaaaatccccattgcag

SEQ ID NO: 12852 - DNA, 703 bp, Homo sapiens
gtgtcttggtacagctcgtggctgtggtcagtgtggtggagggtaggtcttctcagatggtaacatgcatgagagtcacctggggatcacattaacatgcagattctgattccctggatctgggtgggacctgaggttctgcatgtctaacaaactcccagagaacacccatgtagcaagagtacagacaaaaggattcaaagcgaagggactgcaagaaccatggaaccagcctcccacgattttgcggatgacgaacccgagccttggggagtttcagaggccatggagagatgaagtataataaacagcatagcagttgtatgttgagccaagaatcagacatgcacagaactgctgattggaaaattaaatctgtttctcatagccctggtgtggcaaaatgcctagctggaagtgggtgaccgcttgatttacagtgggcctcctgggtagggaaaattagtccatcccatttacagctacttccaatgcagctgtgtcaggggagagagaagaaaggacatggaagagagcgtagaggtatgatcttcagtcctttcaggcaggcacataagtaaatttttatttaaaagataagaattggtcatatgcgaatctcctgttagataagattaaaaacaaatttccattttgtggagaagttgcagataaatatttttccatgggatccaaaagaatc

SEQ ID NO: 12853 - DNA, 274 bp, Homo sapiens; identical to SEQ ID NO: 12851

SEQ ID NO: 12854 - DNA, 703 bp, Homo sapiens; identical to SEQ ID NO: 12852

SEQ ID NO: 12855 - DNA, 349 bp, Homo sapiens
tggagatagagtctcgccctgttgcccaggctggagtgcagtggcaccatcttggctcactgcaacctccacctcctgggcccaagaaattctcccacctcagcctcccaagtagctgggactacaggcatgtgccaccatgccctgctaatttttgtattttttggtagagatggggtttcaccatgttggccaggctggtcttaaactcctgacctgaagtgatccaccacgcccagcctgcctttgtcttttatgtctagtttcttaaatcagtaatgttatctgtccacttcagcaatatgtgctactcaccttaaccctagggttatccaacaatccaagaaaa

SEQ ID NO: 12856 - DNA, 274 bp, Homo sapiens
gcagtcacaaaaagattaaaaacaaaaaacaaacaacaaacaaataccgagatagaccacccatgtaccaaaggtgccataaacgttgagaccattctataaaaactgtaatacacagaaaacaaatgattaagaacaagtatatccaaaacacttaaccacagctcaaaagctatcagaaggcagcatgatgtgatgtagggatactatttctgtccagcacttggagtagcgaaggaacaaagtttccggtgagaaatggaagtctcagacc

SEQ ID NO: 12857 - DNA, 537 bp, Homo sapiens
tgggttggttccaagtctttgctattgtgaatagtgccacaataaacatatgtgtacatgtgtctttatagtagaatgatttataatcctttgggtatatacccagtaatgagattgctgggtcaaatggtatttctaattctagatccttgaggaattgccacactgtcttccacaatggttgaactaacttacacccccaccaacagtgtaaaagtgttcctatttcaccacatcctctccagcacctgttgtttcctgactttttaatgatcaccattctaactggtatgagatagtatctcattgtggttttgatttgcatttctctaatgaccagtgatgatgagcttttttttcatgtttgctggctgcataaatgtcgtcttttgagaagtgtgtctgttcatatcctttgcccactttttgatggggttgtttttttcttgtaaatttaagttctttgaagattctggatattagccgtttgtcagatggatagattgcaaaatttttctcccattctgtaggttgcct

SEQ ID NO: 12858 - DNA, 516 bp, Homo sapiens; identical to SEQ ID NO: 11541

SEQ ID NO: 12859 - DNA, 137 bp, Homo sapiens
tttgatgatggtgacgtacagataggtttttggtgtggatgtcctttctgtttgttagttttccttctaacagtcaggaccctcagctgcaggtctgttggagtctgctggaggtccacttcagaccctgtttgcct

SEQ ID NO: 12860 - DNA, 561 bp, Homo sapiens
agaattttcagcttttctgctctggtttctccccatctttgtggttttttctacctttggtctttgatgaacctgaccttcagatggggttttggtgtggatgtctcttttgttgacgttgatgctattcctttctgtttgttagttttccttctaacagtcaggaccctcagctgcaggtctgttggagtttgctggaggtccactccagaccctgtttgcctgggtatcaccagcagaggctgcataacagcaaatattgcagaacagcaaatgttgctgcctgatccttcctctggaagcttcatctcagaggggcacctggctgtatggggtgtcagttggcctctactgggaggtttctcccagttaggctacttggtggtcagggacccacttgagaaggcagtctgtctgttctcagatctcaaactctatgctgagaggaccactgctctcttcaaagctgtcagacagggatgtttaagtctgcagaagtttctgctgccttttgttcagctatgccctgcccccagaggtggagtctacagaggcaggcag

SEQ ID NO: 12861 - DNA, 146 bp, Homo sapiens
tgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgc

SEQ ID NO: 12862 - DNA, 332 bp, Homo sapiens
tttttaatttatgttacattttggttcacttttaatagtaaatgatatctcaaatgtttagacatttagctgattgtaaaacgttagctaaaatggatcttctcttgaaatggtgttgccagatttttaaaaatgaatagaaattatattctttttcgtttttaaaccatcacttttaccttctgagtttctggaaattgaggtgcacctgtatatagaaacctttgcacttaatttcatttctagttcacgttctatacttgtctcttctcattatagcaattagccttaaaatctaatttccttggctttattcagtcctattgaaacag

SEQ ID NO: 12863 - DNA, 143 bp, Homo sapiens
ggcatggtggcgcacacctgtaattccagctactcaggaggctgaggcaggagaatcacttgaacccaggaggtggagtttgcagtgagccaagatcgcgccactgcactgcagcctgggcaacagagtgacactctgtctca

SEQ ID NO: 12864 - DNA, 712 bp, Homo sapiens
aacttctttgccatgggttcgaactttctcctttggctcagagtagtttgatcgtctgaagccttcttctctcaactcgtcaaagtcattctccatccagctttgttccattgctggtgaggaggtgcgttcctttggaggaggagaggtgctctgatttttagaattttcagtttttctgctgttttttccccatctttgtggttttacctacctttggtctttgatgatggtgacatacagatggggttttggtgtggatgtcctttctgtttgttagttttccttctaacagtcaggaccctcagctgcaggtctgttggagtttgccggaggtccactccagatgctgtttgcctgggtatcagcaggggaggctgcagaacagtggatattggtgaacatcaaatgttgctgcctgatcgttcctctggaagttttgtctcagaggagtacccggccatgtgaggtgtcagtctgcccctacggggggtgcctcctagttaggctactcgggggtcagggacccacttgaggaggcagtctgtccattctcggatctccggctgcgtgctgggagaaccactactctcttctaagctgtcagacagggacatttaagtctgcacaggtttctgctgccttttgtttggctatgccctgcccctagaggtggagtctacagaggcaggcaggcctccttgagctgcgg

SEQ ID NO: 12865 - DNA, 644 bp, Homo sapiens
cagcagaaacttctgcagacttaaatgtccctgtctgacagctttgaagagagtagtggttctcccagcacgcagctcaagatctgagagcgggcagactgcctcctcaagtgggaacctgacccccgagtagcctaactgggaggcaccccccagtaggggcagactgacacctcacacagccgggtactcctctgagacaaaacttccagacgaacgatcaggcagcaacatttgctgttcaccaatatctgctgttctgcaggcttcgctgctgatacccaggcaaacagggtctggagtggacctccggcaaacaccaacacacctgcagctgagggtcctgactgttagaaggaaaactaacaaacagaaaggacatccacaccaaaaccccatctgtatgtcaccatcatcaaagaccaaaggtagataaaaccacaaagatggggaaaaaacagagcagaaaaactgaaaattctaaaaatcagagctcctctcctcctccaaaggaacacagctcctcaccagcaacggaacgaagctggacagagaatgactttgacgagttaagagaagaaggcttcagatgattaaactatgatgagctaaaggatgaagttcgaacccatggcaaagaagtt

SEQ ID NO: 12866 - DNA, 48124 bp, Homo sapiens
gtgtgtcttgtgatggaatatgctgaagggggctctttatataatggtgagtgtcattagacctgtctttatctagtggattaaaataatttgaaaaattttaatataaaccctaagttgtttaacattcttcacaatttgccgtcagagtcccaaaagggcataatttttaaaaatctgctaagaataaaaatggaaagataagattctataacattagtatgtgaaatttagaggtctatcaattttttaagtagatggtactttgcatttcattaaaagcatttaagtaaaagtttactttttaaatagattttaaaatatcttcagatttttttctttttgccctctcataactttgagcctcctcattttagaattctttaaccatatttcgatttcactctgctttattttttcttttttttcaaaaaaaaatgtgaaaactcacttcacacaaccttttatttgtagtaatgaaaaaaaactttgtgtagttacattggagaacagagttcttttaccctaaaaataccaaccatatgcagaaatgtattgtctcttgtagcaccagttatataaaacaaattgttacattttattttttaattagtattattttatgtaaacttttacttatatttactgcccatgtgttcatcattgtgatggatatctaataccccattgtcttatttgattgaactacttctggtttttagccattacagaaaatacaggtgcaaacatcttgatatacattgttttgtttctttctgtactgttctctgcctctctcttgtagtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctcattttgtgcctgcagtatataatgttgctgttagacaattccttgggggcagagataggtctgacgtttttcttgctgtgtccctaacacctagcacataaacattctacagaaatttgcagagttgttattacttgctctttcagaggaaagtaaaagggcatttcttggcatctgggtagaaattgaaaatattctggattcttcataatgtgaatacttgggactttaaaaaacttataaattccttagataagtattttaaaagactaaaactttgggggttttgtttgtataggtattcagttaaagaaaacatacacataaaacatattgtttccttttctctctttttttttcttttatgcacctgtgacacagtaaaaatagtctccacgtatcttctttaccctccccccaagctcccaccccagcacattagtctttacagaagaggtttcccttaggaaatcagtatagtcttcagttattccattctcttgatactggttaaagcattaaaacatcccttctgggtgcaacttgtcactctcaggtctaatctgatatactctacataggttccaactcttagaatcactgttcttgctatgtatcttatctctactcccaaacttaaactgatttctgtttccccaggtcactgataaaataatgtttaagcttttatttttcctgaggctattatcttagttacctgccttaactaatgaaaaaatcacttagcctttttttcttcattgtgaatattcagtcatcctttttccactatattaacagagttgaattattaaagcaaacttatgagaatcacagctcttaaccagcaacaaattgacaaatgatccaaaggatataggcaagcatcagatacagccaaagcattcttttcctaaaagagtctgaacgcatctgatgcaacacccaaaagtatcccttttctcctcgttacagtatgttttggctttggaataaatgattagttattgaacaatatatggagaaatatcttacaaaaggaagtcatttccattttctaacatcttttacattgcactaattacatggtttaaatgactatccctaatcttcatccaactacaccccatgaattttaggtttatttaatcaacctagttagaccagatatatccttctaaaatcatttgtagatagagattctccttttgctagtaaataccattaacatatttacagaaggtctggtctaggtcatttattccaggcctctccatgattggattcatcttgcaaatcgtctttggagcccctggtatacaagttggactttagaatcagaattgattctagttcagaaagtactgggtaaaagaaattctttggaatggctatgattttatatataattggacatacatgaatacctgctatatctttattttttaattatttttattattattattattttttattttgagacacagtctcgctctgtcgcccaggctggagtgcagtggcgcaatctcagctcactacaacctccacctcccgggttcaagcaattctcctgcctcagcctcccaagtagctgggactacaggcatgtgccaccatgcctggctaattttttgtatttttagtagagacagggtttcactgtgttagccaggatggtttcaatctcctgacctcgtgatctgcccgcctcagcctcccaaagtgctgggattacaggcctgagccactgcacccggccaatacctgctatatcttattgtcagtggaaaacctacagattctgtggtcaggaagagttcctcaaaatggtatctaaagaaggtacctgatgatctagggaggtgttttatacactatcaagttgtgcttgtgcttgtattttatcttttgcaagtttattcacatttacattagaaattaaaatgtgtttttaatcttaacagtgtgaaagtaagcctacaaagataatttaagttcagatttcagtgagccctgaatttcctgttcaaggctggtgaacttttgaagtcgagtaaaggagtactaacataaaactcattcaggaaaattatcttgaatcatcagaaattatcttgatatcttgaatataccagtataaaacaaggaaactagttacagagttcttataattttcttgggtaaaaagtgtaagagtttgaacaagaacattgagatgcgggaaaaaagctttgttgaagtacatatagaggtatactggatttagcattcttttcactggaatgattatgagagtctttttggtattatggaactgtgaatagtagtttatctgacttattttagtcacattggactaaaagagaagaaatttccaaatagtctctccagatgtaaaaagtttataaaacttgtaattaaaatgaattcctatgtactgctattggatattactacaatgtgatggtgcaaattatattacccatttctatttctctttgtcatgaaaagcaaaaccttgtaagtaagagtatgctacttggtgactgtagttgggtaatagtacacctaggaaagtccgaatcttaagttcagaaaattttccagaaatctctcattaggtcattttagctataatagatttgtattcctcccacacattcatagtctaagcacaaaaatggttttgggattgaacatttttagaagtatcttcaaaataaagacattaaattacagaccatttttttccttctatattggattattttctttatatagtgttactattttttaagtaatacatatttatgattaaactcccatttcaggataccgtaatgttgacctaacagaagttttttaaaccccacgttttattttggccagatagaagtatgatcaggaaagattttggagctagagatgaagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataagatactaagaattacaaataaatgtcaagcttatatgtttaccttcttttatacctccatatgtcactgaagttttaaaagagttgtctgtaaattatatgctaggtttctgtataaaaacatcaaattatcttttaaatgaaagaagttgaactgaaggtatgtgatttgtatgttaggaagtgtaaatgcccataaaattcagatacattcagttaatcagactctggttatagcttatttctttcagttttgatgactttaaagggttttctgtttgtttttagccaccccagaggaagagaaattgcaatgcaactagtcacctgagtggagctcttttgccctaaaattcaatttagtaataaatgaataatcaggtgttatattacacaagattaaataatgcctcctgtttcatatacagaatgtatacatttgacattgttttaaaattatttacttatttaatatacctttatgtgagttaaaatgacccaatgttactgtatgtggagagcaaaaagatttgtttatacaaaagattaattttattgctctagacaacccttaattgtctagagcaacaaaatgcagactgttaggctgtgtaagtttcttcatttctgaaagatgtcagtcaacctgtagcccaaattagactgtagcatggttgtagtgctatattacagtgtactgcttagcatgtaaagctatagctataataattgttcattcttacagtgagttgagtgtttgtttgtttttgggagattatgacgggtgcttattgtgctggctgattcaaccacctacttagtttgtaaattttgctgtgtaactcaggttatccataattttcgttacttacaacgtaatgtttaagtttataaattaagaatttcccttcaccatatattgaggaaaaaactgtaacactaaattagaaagttcttctgctttgatagcagagtagtgctgtctgtcagagtgggaagaaaatttaagattaaaatgtaacagaaaggaggccaggcacaatggctcatgcctgtgatcccagcgcctcgggaggccagagcaggaggatcagttgagcccaggagtttgagaccagcctgggcaacatggcaagaccccatctctacaaaaaatttaaaaaattaaccagttgtgccagcgcatgcctgtagccccagctactcaggaggatcacttgagcccaagagtttgaggctacactgagctccagcctggatgagagtgtgagatcctgtctcagaataaaataataataaacaacataaaggaatgtacagatgtttcatactctgccccagagaaagtatcagtctaaatacataaaagtcaagtcctgtgcctcttgatgaaaaaactgcctcttgatgaaaaaagatagaaaataactgagtttctgaagtagttttttagtgtattgttgatacttaattcatttaaaaatgtacttgttgaaaagacaaagtacttcagaaagagtagtttcttagttctacatgtgacagcctcatttttatccctgatacccattctcaaaatttaagccattgtttctgtaagtcatgtggaaaaatagtctttaggttatatactaccttttttttttctaggtagtaattacagtgaaaaatgtgacgtcttcagctggggtattattctttgggaagtgataacgcgtcggaaaccctttgatgagattggtggcccagctttccgaatcatgtgggctgttcataatggttcgtaaaaagaaatttttcttaaaagtactttttgtgttttctacttggaagactactcctgtccccttccctaaagaatatcatttatctctaacattaaaatgtacaattctttgttaagagactgctttgctattatcagactctgccctgtccctgccccagagtccagcagagcaggattgagagtagtcctggtctacacatgcggctgaggatgttcactggctccgctgattagggaaaggccatcagtacgcaacctagacagttggctctctcttagggagaagcatcaggctggatcatggaaaaaataaaaaaatacatacataaaatctctgacatggttaatataactggagagttatagcccttttctcctgaagaagcaagggcctcatcaaggagaagaagcaaagaataataatgcttcacatatttttcctgtttatattctcacccacccttagaaggtgagtactgttgcctcattttacagattaggaaactgaggcctagagaggttaaataacttgcttaaggtcacaagattagtaagtggtagagctgggattcaaatccagatgcttctgacttgaatgctcatatcttaagtcatattgacttatggactcaatgtccttgcatctgtcctgtttcttttatagttctggtaatgttgtttttaaccacatatgatgttagaatgcatcctcttcattagtaaagttactttacatttgcttgggaaaatagcttttcatgaaggaaaattacttaccttcttaattttagcgccactcttagttatttcatttctatgccttgtttataatcatgtgactaatggccattttttacattattccacaagtctaaaaacaaatgtctgcctaattatttaggtcattcatagatttatcaaacagtaccatcatctgagtaatcttagctgtttttaccagtttcctatactgcctttaatattactaccattagtatcattgtggagactgttcagcattgaccaggacagcttgcttgcttgctttctatcagttgtcagtaaataattgaacgtccgtgaagtaaagagtaaaagaactaacttgttaattgataaaattacaaagcacttttattactccaaattacagatcttaaactacaagatctataaaataaataccactttggaaatacgtacaaagagtttgcatcattctttgggtaaatacattcttccccccttcctctcattttcaattgtaggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggtaaatggatagattggaagagtattgacttgatttttctttcatctctattcccatgaaattataatcaagaagtaatgaataatgtccccatttgcattttaattccttcatttcatatgattgactgcaatttgagtttacaggtgcgtcattcttcatgtaggtaccctgattaaagagttattgaagacctgcttccaagtcttagaattcctacataattatgaataaaaagatggcatattgtattacagtgaatgtcattcttaacttgaaaaatcacttttacatgcatactactagatcaagtagtattagaaattattgtaaatgtatttaaacatttcttcatcacgaacaccctagtttttgttctcttctacagaggctctgatttaagaagctatgttaaaagttccttagttttccgaaatgtgaagtagtagtgggacatgtaatttgtggtcatcaaaaagatagtagaaataatactgtaacttagaaatattgtacttctcaaaatatagtggcattataagcatttcattattaattgaaacttaaagatatgtgtgtgtctatatgcacatgtatttaccctgcatttattgaaaaatacttttactgatctatttctcccacctcaagaatagttttatttattttaagatggttactgcttggctagttattctcaaattccagttttactgaaaatattttgagttgctctgaattctaaaatgtacttctctaaaattctatcatttgtgtctcccacgtcctctaaactctctcttcatttccttactgtgaccttgaattttttgagcctcccaccttttcactggtcctcagtcctcttaggtccttttttctttctccctccacttaattccaatcaactattataattcttttgggaataattttcatctttctagcctctctctcaagcttgcttggctaaaccacaagcctaatgaaagctgacactcggcttactccttgcctgtaccaatgcagctgagtgtggctggagatagcacaggtttactatcctcacgtgcatgtttagtgctattggacagttgtactgtattgtagttcatctctttcctcctatatgtcttaattttatactgtagcctctcctcagacttcaaacacctcctcgccactcctcactctcagctgatcttgtttgctctttctctgagaaaattggagtaatcggaagacagcttccacaacatctgtgcccatctactctgctttcttctgttactctggctaaactatccatacttctggccaaaggtgtacctttctgcctgtgcattatatcccatctgctcctctgagcaattctcccctgtctcttgcatcatcagttttagctttctactggatcattcctaaaacatacgtagtctgtatttgcattcactagcttctcttttccccttctttcttgagctgactccattcagacgtattatgccagtacttcagaattgttcttgtcaaggtcactagttatctctacatcactacatttaaggaatcattttcatttctcatcttgactctcagtagcacttgacctaattcattactttctccttcttacagacagcactttcttcagttggcctccgagataccatactagcctagattccatcttacatctctggccgtctgttctcagttttctttgctggttattcctcatctccccaacctagaaatgttggagtgcccagggcctgctcatttggcttcttcacttatctgtctgcactcatttccttggtaacctcattcattattatggccttatataccatctgttggctcataatgttttccatcttatacctgaactctatactcatatatccaactatttcctttacatctactagaaactcaaacttaatattttccaaactgagttcctgatacttccttcaaactcactcttcctttagtctttccgcatctcaattaatagccctcagttcttctactagctcaggttaaaaaccttaagttattcttgactattagaagactatttaggcatcttggttccttttttgtgctatccttaagtttctcttaaaatgggtttgtttggatatcttcattagcttgaaaagtcttattttatttctgttcctgcctggctagtttataaaagaatgtaagttacataataccaagtgaagcatttgtattatttccagccattagtcataaatgtttctgcttttcctaggctcattcatggacattgcttctacaaatacgagtaacaaaagtgacactaatatggagcaagttcctgccacaaatgatactattaagcgcttagaatcaaaattgttgaaaaatcaggcaaagcaacaggtttgttatgttattacaagtaaaactggtaaccttaccagtagtcacaatattatactaactgaaattaattatttaccatcttctattttataaatcctgaattttcttcctgaaacatgcaaaagagcttacaaatagagacacgtaatgagattctcctaccatttattaccaaatggtttttccttctaatgattgctacctttgccaattctaaatccctatctataataatccctaaatgtaatggttgatggttaaaaatgtaaaatgggtatattttggctgcgctgcccagttagaggagttgttctaagtctatcatttcatgctgttcagatttattatatttttgccattgttgatttttaaaaatatttcaaggagtgagtttattcattttgcctgaggcatttaggttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaatctaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggtaaaaaggaactacaagtctgaagagtgaaaatgtatataagcctttttggccatggtagtttcagttgtcaaaggttttttgtgtgtgtcttatatttttttttaaataggaagtaggtttacaatatatttttctaagttactagcaatagtttatgcatttatctcaaattccaaataaggaaggtatgacttgtaaaattatttggatgagaaagtatgccttcctcatttacagattttatcaaatgtaattctttctgctcaaacatgagttgaaagtctaagtgagaaattgaaattctgccaaaaccagaatattttggggattttcagtgatactactagatttttgtgctgaactcaaataatagcaaatattttgtttcaaatttaacagaaaaatgtattccagatccatgtatgatttgaccttctatctgcttcttcattccagtgacaaaataatagctaagctggttgtggttaatttttttaattgtaaaataaaatatcataattttattagatcttgaaaaagctagcatttaaattccattgttcagttcttaaaattattaatcatggaagaactggtcagcacaaaaacaattacatgttttgttacttaagtaaactgacaacctaattctgtgaccaggtttcattttagtaatgctggtttaatttggacgtttttggttttttgctgattctttccagggatcagggggagctgattttaaaagtaaacacgtttctgttgtggaaaatgtggaaatgtaaacaagccaaaaaaacttacataattaccccactcagagataaacacttaacatttttgtgtatttaccccatcttttaactatgtatgtgtataaatgtatatattcatgtgtatttgcatcttttttaacttagctaaccaattttttaggtctttttttcacttatttggtttttttctaaatagaatattctcattgtgtgtggagctcttttcagaaagaagttgtcaagatggaccatcatactatacttgtcttcaactaatcatgatcattgattttatcagctactattagaatccattagatataacagaatatccgaaataacagtgtctataacacataagcattatttttcacatataaacaagtctggaggtagtgggctctgtgatcttgaagtaactggtctcctatttctgtgctgtaatccctactgtatagcttccattctcaaagttatcctgtgctccaaaatggctgttgaagttccatttcatcacttctacattccaggcaataggaaggaagacatgggggcagggcaaatagacatccaagttctttgaaggaacattcccagatgcctctcttaacaacatccacacatcattggtcaaagtaacatggtcgaatggctacacgtagctccaagggaagaggagatctgccctcttttatctgatgacttttctgtcctaaataaaatcagagtactattgctaaaacagaagggaagagtggaaactggcagaagatagctgtgtctgccacagatgggtcttcagaaactatcaagttgagtagaagtcaccagccactgacaagcccatgagtctccatgagtcacaagtatttctttggagcagggttgtctcactgtagtgtcagatgaaccctactcaccgggacataccctcatgctttgaggaacccttttcacttcagggatgttgttcaggatagatctgccacatactaattgctgtctcaaaactgaaaattgttataataatggtttcatgtcttcgctagtatcatatttctagtcaagcactggttttttattattatttacagaaatgactttgctagaaggataaccacacacattaaaattttgcctaagtgtagaacaaatgctattgtacatcccttgagttttacacaatttaaattttttcatgaattgtcttacttggaaagagtcatactttccagccttttgacagactttgtgtttactgtgaatgtaccctaaactttggaaaatataataaatatttggtactagaaatatgtataagtatgactacaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaagctaaatgagatgtgctgttttgcagggtatcttgccaaagaatcatgtaaaatagttggtcaattctgatttttgtgtattatcaggagaatctcataaattacatgtttttatacctaacttacacatggtactttagtgtctaaaattggtaaactgctttatttcttatggtgatcatttcatagaggaatatgttaccatttttaatagaaacttaaatggcatattgaccttcagtattgattaatgtattatcaaaattatcatttatttatccctttaggcttttctctacctctttacccaaaatcttgataaggaaatacatattttccacacacgttcatgagtgcgagttggatgaattcttcagcatgctgtcctttgcctgtgattgtgtttttagcagtgttgataattctagttgaatacctaatggttattttctcctctactaaactgaaaactatgtaaggatagaatccatatctttgtgcattattttgttgttgttgcttattattgattgtatcagcagttgctggctcagtgcttcacatattaagcatattaacatagtgtttaataaatacatttattaaataaatgaacagacctattgagcatctcccctggtgagaaactagcatacaaaaatatgaattatactattcttaggtgccattttgtctgtataaaactatcttatattaattttcccctggttatcaaagtggtttcttattttacaacatcattactattgctattcaaagagtagagttaacccatttttcacatggtaatttttatttattgaatctggactgcttcagaaattaacaaagagatcattttacatggagatcagtttacctccatgcggaaaggtactgtgtataagggacgtactttaaagaggtggaagcatttaaacttacataccgctgaactgtgcttcccttaaatgtttgagggaatcaggaaaatttagacagatggcagtgtaatcttatgactaagcattaagaataaatttatatatggcagcgtagcccacgctatacaagataatgggggagggaaaaataaggaaagaataatagtttataactgtcaggtactactggcatctagtgggcagagaccagggatgctgctaaacatcctgatgtgtaccaggcagtcttctccaacaaagaatgatccagcccaaaatggcagcagtgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaacattaacttactcaggtgcactttctttaatagaagaatacaagctgtagaattgacactagtggacataaaagccaatcatgaatgtgctcataggtaatgtttttaaattaaatataaaaataccgcccatcctttgggaatatctcaaatttcctacatgacattttaattgtaaagaagggtgatacttaatttccaaaatttcttaatactttctagaaattgttttgttctaagtggatttcccacaagctttatggtattagcaaatacttcttgatatattcaaactgtttaattagcattaaaacccaattgcaaggattctttttaaatatagctttttaaagatcttatttacatggataagagtttcgttaatacttccctttggccaagtgcaatgtactgagtctaatgtacttcttggaatgaactacctctcttaataagagcaatccttcaagcatcacaaaaaaggttttgtatatatatctttaaagtcactaaaatgtctaacctagtcataggtaaagaaatgcaaagaccctaatcttgtaatcttgttttttgctcgctcttcaaaatgtgtatactatgccatcagtcaaatgtggaagaaaaagcaacttagcaaaacagcactatttatcaatttagtagtctctcagatcatacagaaattaacctttaataccttaggactccctgtgggtcagactgtacaattttttatacctcttctaccatattactggctctgaagaactgacaaacttttgtacggtaacccttccttctttccactgtccatctgcccttaaaagagtgagctttatagattagcctggctcctttttaccaaggaagacacgcagctaagagcaaattaccagtagagtgtgtgacattttgctgactcttcctttgtagagaaggtcctgccaagtagcagtgtgctacctaagcaaagtaaatgtaaatgtggaagtttcttgcccagtatttagaccatatgaactacagttttctaatgcatttgcttgctggtaagttggaagggacttcgagaaaagaaatagattttcttaaatgttttttattaaaacttgagttttaaaaaccatatcctttctcctttcagccagtacatctaatttgttacatttatatttgaagaaaagggaataggtagcagattattggattctttgaagtttttctagattttttttgttctaggactttaataagggcagtaagaacacagatcattgttttgcatggattttctttactttttcccatattttctttttgtcactatctaagcttccaagaatctatttttcacccaccttcatctcaagtacacaaatgaaatagattattgggattgtgaaactatgtaagacattctaatgcagttcatctgatgttagaagaatacctaaattttacatttcttttaaaaatccaaatgtcaaagaggaacaggtagaatgcctaaatattacaaaaaaagaggaacaacctttttcagtttaacatgtagagtaagagaataagtagttaagaaagcgaattatttttcatgcttgtagcatcagtaatggaagatgggttgttctgctctggagcctttgtgtgagtagttatagcatttaaggaaataaactgtaattataatgcattctaaaatctactggaaaaaaatactgtcatatacatatatacttaccacctataaaagatttaattaaacattagtcttctgcacttctactctgatataaaatttgttgtacatggttcataccggcttgattgcttttataaagtgaaatgagtttcccaaatgtgatatgcaaaagtaaaattttctaaattacagacatttttaatgctattatatcatcatagataaatttatttcttagttcagattagattataatgcttgatttcaagtacttgaaaaccatccattctatagatgaacattgccttgaagtgcttcaatttgagaaccttgaacagtgttgctttagtgtaccttttgttatttctaagcctaaaataatatggcataacattcgagagcaataaaatgccttgaccaaagaggattttctgtcttacatactgttcttaaggatatgcaaaagaagattgaatatacaaatgtttttgagtcagatcttactgaaatagataagatttttgcctagtttcctgaagaacctgaacttaattgatatttattgtttgttatatcattcttaaagctaaaaagaaaccttaggtgtccttatgatttcagccgcatttagatctcttaactgaataaaaaacgcgtattcgcttttaatttcagtcaaggacgtttagctctattgtatattggttttttactaacagtatgataagtagtaaattggagtaagtagaatgtagagaggcccaaacattttaactgaaaaatagatgagtagttaggcttctaatacttgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtcggtaactaatgtttgtaaacctttctttaactggaagcatgtaagttattaaatatttcctccagactactgcagcaccaatatgaagaggcaaagagagaaagaattgagtttttctagatctggcaagttctcacctagcacagatagtgtcattagcagatgtaagcctttgatagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaaaaggtaaaatgagtgaatgtctaaattagtattcagttgcaaaaaacttcagaatcaattcaaatttactgagaacacacccagtaattttcatttgaagtaataggaggttgatttttcttacattcatatttctaaattatgacttaaaatttaatattggagcaacaagtatttgttgattgcaatcctgttttgctttgtctgaactatctgccagatggtttctgccatggttgtgctaattaaaatgcattgcctaatactgcttgctttgattcatgcagtagcttaaagatttctcattttatggcatttgttaactgtcagctcttctttaccttacttccttaaaaggttttacttcccttttctcctatccttccacctaaatttaagttcagtttttgttgttattgcaatggtgatgtaatggtttatagacacatgtgtcgggtggttcctcagattaacaaatgttgctgtgttgctaatctgaaaagagaattccagacacttttacaagcctgtctcatcaccgctaattttagaatgaatgtgttgaatgaaatgtgcctaaaattgcttattagtcacggttgtggggatcctttttgtccttgggaaacaggggtagttgaaagtattcagaaaagtaatctagtggatctaattcaataaatgcacagttttgttgttttagtttgtaatgaaaagttgaaatttttggaataaaatgaaatttgaagtaaatgtgaattcagataatgcaaagaattataaaacgtagcttaaaatggaaaaaaactgatgatgtcttacatttgcaagaggagttacaaatttgagtttttatattcactacacatattattctattaaacattcttattccattgtaaggtccttttagtttatctgcagcataataatggggtcatgtgggttaaggtgctaaattatattgctgattggttttaaaaggatgtctctacgaaagattctggaagtctaaaattttaagaatgaattctgtctactaatcgggaaactacaattagagtgagtacatgttctaagtgttgcccactagttgagaaattacgtaatacagatttcagagtcaaaagaattttgagtattgtatcagctgttactcagtattttggtgtttccttttagacagctgatctctcacgttagaagatactgcataaacagctttattcccaaataaaagtgctgagtgaagccattgctcaattcattgttttgctgaggacttatatgtgtagaattctctcataaattgatttttaattaaattaattataaacatagaagtttctaaagcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtaagacaacattcaaattttctatctttgaagaatactaggcagaaaacaagaattaactgtattctactctgcaaaattagttttatgagttgacctaaagttgtgatagagaaattcattgcacctgaacttaaatacttaggggggaaaaaaacataggtgccattgttaatttaacttgaaagataatttattaaagtaggtttattaaactccatggaaaagtaaattgttcattagcgctgtatatatgttatatggttttatgtatgttttaataagtattcaattttataatttaacaatttatcattaaagtgtcctttaaagtgaatcattaatatgtctcctttttactaataagggtagtaaacatttccccaataagttgctactcctctagcgccacgtagggcattacatggagaactctaacgtcttttaacttggcatatccactggattaatatttttttcaaatatccttaagataacatttactaagcaaatgtgtaaactctcgaaaggcttctattccagtggttaagatttcattgtttatatttctggatcctcctctaaactctccttgtctctttatcactgctgctttgcagatgatgcagacagtgttataatttaagccattactgattagtgcagagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagtcattaataaaaaagtcttttatacccatcaaccaacttaccaaaaaccacttcaaatatttaagtggtgaatatccttgatcttcatttatatctggaaatatgtttatttcacaaaatgcttataaacacatatataaataaaatctatatagacacattaatttattatgttttgtgatactagtgactctaaatcttgatttcattatttagtgatagtttttttcagtgcatctgtttttgtaagaccccagaacttttggctgaagtttcccgttttctccccctcagatacttaaaagttttaatcagcccatttagtaacagatagtttgacatctgctatttgctttgattctttggaggtttgatgagctcagccttttaaactctgtttactattgccactgatattccagttatgagaacttctagccaactgtttgactaggaatgagaagcttgtcctaagacatgtcaggagcagctactagtttgaaagcttttctgtagactctagaataaaagtgttgccataattcaggactgatcttcccacaccaagtcttacttatttcttcacaagttccacattatttgagattttcgttgttacccttttaattcacaataccttcaggtagtaaaacgctggaactgaggccaactatgggtgtgggacagtcatttgtggaattgtcatagaccactctgaaagatttggggtgagggagagtttgatatgggtgagggagagtttgatatggcagtaaaacctgttctgaaacaggtgatgtatgaccattgtgtagccacattttaaaactgatccactctttcaaaattatttgtgttatagccttaaaatgcctaatgttcagcttggcatgagagtggcaaatactaatcctaatgtactatgaaaacatttctcccaaaaaatgtatgataagtgaccattaaatcttttaaattactcacaaagatgatattcatttgaggaagaaaagtattcacaatatgtgttttcaaaattggaaggtgccatcctttttgaagtctggctaagcgtgattccatcttgcagaggaaagtaaacttattgtactgtggctcttgactcaaaacataatcttagtaaaaccacttagaatttccatctgtaaactaaaattaaattggttgtttttctgctgccatccatttgagaggaacagtaaatgaagcaagcttcttaattaaaagtaatgatataagtataggtgtaaaagattgcattcttacaacatacaactcactttcaaacatggttttttcattaattcaggaagctttttaaacactcaatagatgtgacttcctagaagctttgaaaagatactgagaaagaaaaaagcagtccctgacatccaggaactggtttgacactgtggcctcactgttgttagtagctagccttattctcaacggctggctgtcacagctagagcatgttactgtcttattggacataatctctcagaacaccaatatcagacaagataatgctgagaccgtgataaaaggagacaaaacaagactacttcggaatgttttctaagcacagacaaaaacaaggtcactgtgccacccacaaaatacctaacattgtcctctcccagctattaagagtgactgctgcttctttaccaattacagcttggtcctcactctggactgccctccctgtggaattgcccttgctttctgacagcggccaatctggaacgaacccctccttcctttgagtttccccaaaatcactcaaccaaagcctaaatcctataatactttctttttctaaaaccctcttactgagacaccccatgctgccccatggtaagcattctccttcactgcaataaatattaaacccaactctttccactattggtgtgttcctggcagtctttggctagagggctttgacaataccaataaagcctattccgcaaggacctcatttggagagatcagacttatgcccaaatcaattagaaaactaaagtaataacagcttccatttgttgtgcactgactttgtgccagataggctcttagtatacattatcagaatgttaatcctgttatcaggatcttagtcctgtgaagttggtactttttcacctaatttgcagccaggtaaagtgaggatgagagaaactgacctaagtctcttacttccttatactgccagtaattcctataaccaggttttgaatccagacctgattgcaaagcacacaaactctatactttaatcattctaacttgcatgtgaaactagatgtgatgcatgctgttatagccctagatctcttacatttaggtattttggcttctaatagtctgcattgtcattaattatttaaacagttgttaagtgatgatgaattgtagctgtatcatatcattgaacaaggttaacctatcttgataataaatttctaccaatgactgcacaaatttatgttttatacacctgggtgagccattctgtgtttcactaaaacaatatacattcttataaatgcctgaataccccttctggaattgtattcagtatagatctatattcaagaattctcttagaggaggctgcagtcagtgaaaattacgactgcaagatgatacagttatgattatttagagaagtgggcatattacatttccatatggactttataatctacttttactagtcaaatatgtgactttgggcaagttccttaatttccctgagcttctgcacccttatctgcaaatagggaccataacacccacctcccagagttcttaacagatgtgaaagtgccagggcacacagtagatactaatccatgttgtatgccagcctctccacagtgtgcctcaccgggctcttgatatcacttccttgctctcatgatagtgagaaataaaaagaaaatagcacttggaaagaagtaaaatccaccagcgttctttctgtatcataaggaaaccttgtgtcaaggatcatggaaagtatttgctttaaaggtctcttatcgcatattgagtgatattaatatacattgttattatttatttaagggatgtgatttattatactacttttttccatcttcattctgcacctccttttgtgtaaacaaatgttctggtaaactctaaatcagaaacttatgtaatagttttgaataattccttcttcatagtatacctttctattggagaatagacacgtttcttcttttttttttttttttccgagacacagtccccgctgtcagccaggctggagtgcagtagtgtgatctccgctcattgcaacctctgcctcctgagttcaagtgattcttccacctcagcctcccgagtagctgggattacaggcatgtgccaccacacctggctaatttttgttttatttttagtggaggcagggtttcaccctgttgcccaggctggtctcgaacttctggcctcaagcgatctgcccgcctcagcctcccaaagtgctaggattacagtcgtgagccactatgcctggcctctgttggagaacagacacctttctattgtagaagaccatgtaagaataataaaattctgaaatttccttatgaaaaactgtagtgaagccaaaatagatcaagcctacagacctttagattagaaagaatattttcagtacaaccttcatgtatagatttaattatctgtaactaccataataagtacccatgtaaatccacattaccaacttatacccattttaaaaatatttatattattgagatgttactttagcaagaatatcatagaagtcatcatttaatctctgtgttttgtgcttgtataattttagctactaagatttctgagggtattaaatagcttttaaatgtcagtctaaataataacactgggtgtaaattcctgacttatgaaaatattttcccagtctttcaggtaagatattaaaagctgagctttatttttgtctgtaaaataacttccaattcctttttataaatatagggataaatttctggtcaaaggccaattctggttcatgtctactgatggtaatctgcccctgaggtttaaatttggcttagtattcttttgctgccttaaattgctgtgtcacgtttctatactcttgtgactttcatatccagttcttttggtaagtcaagtttgcctatatctcttaaactttgcaattaatgtggggatagaataagtaattttaaatgtcttagaggaaggagcaacttaaatgagttttaatagtttgagagcatttgtgaccctcagaattttaccagtgattttaaaaaataagtactgtaaaaacttcttcagtagttggttacaagcagtaacataaattcagccacaaactagtttgagttttttcattgattgtcagatgttatgtgttcctcttatttatgccttgtattattcacatactcaaaaactacagttatgccttgtttttaaatatttccttagtttttttatacaaacatattagcatatttttatttattgagatacacatttcttaaaatataaagatttatttattagttaatggatttaaatctaactgtgctggtctaaaaacagttttgaaacttgcattaaaagtgcaagccttatatttcttagtttcatagctgttggaaattacaagtgggacaaacaagcatgcacagaaggtgctaagagtttcttggaaagtagaaggtgaaaagaaaggtgtagcaaagaatcattttgcaaaagatttaagcttaaggagtactataaaattcctattaggtccaacttatttgttttaatattgcagatgttcagtgacctcttttttaaatatactaaatccattctcattttaaaaacctaattattacttctactgtattttgttgatttctcacaactgatactgattcttacatgtcacaaacatgtgtttctctttttaaaatgtgcattagcattacactgactctgaaaccctggtctgccaccactttgaaggaaaaatgcctttgatttataatagcagttataactatgggcatatttgtgtacttgctttcagtcaaagaaagttaaaaagactcaggaataatttcataatgtctatacttgctttgtcaagggtaaaagtatcctaaaagtaagagtgaaacatttcatcactggttttctttggtgtatgtcgttgttattcttatatactaaaggtaaataagcttaagcaccaatcttgtatctgagtgctaatagcttgtgttctcattttattcaatgagtatctattatgtgtttattatatattcagcaatttcccagatcctgggaagtacaatataaaaagtacgcatggtctctgcccttaagaggttataatacttttgaagaggagtaaaactttgagactactataatttcgggcacaagttgaagtaggaactgactatacagccaaaattcaaagaagaaaaaaatctcgtgtgaagacatttcatgtacatcatttcatttaatttttataaccttatagatagataatactgtccttattttcctattgagtcttagaggttaaataagttacccaaagctgtactagttagaaatggcagagcacagtcaaactctgggctgtcttgtctccaacacccaacttcttactgctactactttttctcattcacacttcatcaatgagaaacctaagtctcagagaggctaagttacttacacaggttcacacagctgtaagtggcagaatggagacataaccccaggtctccaaagtattagactgaaacatgtgaagttgctgagttttcaactacaaaaacaccagttttatctggttcagttttatgcatgccctgtgcactacgccgtattatctttaggtgaatatgaggtcaggattaaaaactgcaagggaaacaggggcatgaggaattttaagaggagagaaaatccagatgggcaaggtaaacctgctgatggagagtcatgaatgccagagtgagaatttcagaattgattcagtaacaatcagtaaacgaacattttgcctgcagtacactgttaggcactccatgtcctcaaacacaaggtctggccttgtacacaaacaaccagagaagtggcaagaatcaccacataatgtagaagaaaacctgagctgggccttacagggtggggaaggattaacaaggagaagaaaagaacagaatgagcaatcttatatggagttaaaaattggttatggtgtagaaaagctttttggaatttctgaagcaatttcagtgggtacccaaaatgaaagtcatatttcatcagtttttcttcaaagttaatttatgatttttttctctgaaattgttaggaaagtacctttcactaaaagtataattagattgtttgtaacacaaaggataaatgcttgagggaatgggtaccccatttttcatgatgtgattattatgcattgcatgcctgtgtcaaaacatctcatgtgccccataaatatgtacctactatgtacacacaaaaattaaaaattatttttaaaaaaacagaaatgagaggaaaacaaagtacctgtcactgtttattatcctgaatccattgtggcttttcaagacctaaaatcatataattttagcactatatggaacacttctcatcacattcttaacccagccccaacccctctccagataaagagaggttgaagtgatctgaagcagacattacagcataattagaactcacatacgatggattctactcaaaggtacttttgtattgcatttcattttacttgttgcagtcttgaatttgagtgtttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaggccgggcgcggtggctcacgcctgtaatcccagcactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaagtccttatgaaacccattttagtttctgtgtcctttgaaaggctttaatatatgaaatataaatatgtagacaagaatgtatataatgtataagttatgaaaataaaatgagcacttgtgaacccaccacccagcttaaggaatggaacattagcaatcccagtgggggttggtccctgtgtgttcctcgcctgtggccttccctgtcatttccccaccaaccctcagtgccatgttctgtcatatgtcatgtttccagatatcataaataccttttatctgattaagaagtcctcttcccactgggcacaggggctcacacctataatcccagcacgttaggaggctgaggcaggaggatcgcttgagcccaggagttcaagaccagcctgcacaacacgggcgagaccccgtctctacacaaattttttttaaaattagccatgcatggtgccgtgagcatgtggttccagctactgaggaggctgaggtgggaggattacttgagcccaggaggtcaaagctgcagtgagctgtgttggtgccattgcacaccagcctgggcaagagaacaagaccctgtctcaaaaaaaaaagaaagaaagaaaaagaaattctcttctcatacatggaatttaagtttgttaaatgtcttttttataagtagatgttaaatgttgtcaaatgctttttctgcatctgttgaggttttgtcctttaatctgttgatgtgattaattttattaatggaatttcctaatgtcagatgagtgacctttgcagtcatttgcaaagttggataaactaaactttttaaatggtttttattgcttctacactgccacattatatttgctaatataatttttagaaattttgacttttgtgtctttttatttttattttatttttttggaagtgaggttcagttgtaactttctttctcacactgtccttacatattgatttttactgccttcacagaatgggtcagaaagtttcttctttctttgtttaggataatttaagattggaaaaatccttatcttgaatgtttgatagaacttacctgtaaaaccctcctctgtgcttggtattttctataatgtataggaatttttgaaacttttttttaaagaatgtgttcatttttatagtattgtctccgatttcaaaatactatcttttactatttttcattttgggaggcaaattcttttttttaactaagttagatctctagcttataaattgtcagtgtttctggttttttcatatatatatttagaattaaatattttcctttaaatgctcttatagtcacatccccaagtattagcatgattcacgttaaaagtcagttcaagtactttctaatgtcccttttgttttcttctttgaccaatgagttatttagaagtgtttttcaaaacaaaagatttttaaaggttttgaaatcagtataaaaagtaattaagttatgatactgaaattttttttaactttgagatttgctttatagcttagtacataatcagttttcattagtgtcccatgaatgcttaaaaagaatgtgtattcttcatttgctaggcgtaaagtcacttatgtttagattaagcttgttttttatggagttcaagttttactgtgtgtgttttgttttgtttttttggtctccttttatataatttacagaagaatattaaaatatattactgtggggctgggcacagttgctcacacctgtaatcccagcactttgggaggccaaggtgggaggatttcttgaagccattaggtcagcctgggcaacataacaagatcccatctctacaaaaagtttaaaaattagccaagtgcaatatcatgtaactgtagtcccagctactcaggaggctactcaaggaggatcacttgagcccaggagtttgacgatacctccttgagcttttttactttatgtgtttatatgtacagcatataaattttgaattgttggccaggcacagtggcttatacctgcaatcccagtgctttgggaaactgtggagggaggatcacttgaggccaagaggtagagaccagcctgggaacgtagcaagaccctggctctacaaaatattttaaaattaactgggcatagttgtgtgtgcctgtagtcccagttactcgggaggctgagatggaaggatcgcttgagcccaggagtttgagggtacagtgagccatgatggtaccactgcactccagcctgggcaacagagcaagaccctgtctttaaaaacaaatctcactgtgatggtggatatgtcctttttccttgcagttttttgatttatctatttgtatgtacagcatataaattttgaatcgttggccaggcacagtggctcatgcctgtaatcccagcacttagggagactgaggcaagagggtcacttggggccaggagattgagagaagcctggtcaacatagtaagacccatttctacaaaaaaaaattagtttttaaaaaataaattttgaattgttgtattctgaattgaaccacttatcatattatctctttctctagtaattttttggaccctaaaatacattctctctgatattaatataggtaccttatttggggtagtttttgcctggttttctttttttatcctttaactttctgttttctctgtctctgtaaattagatatgtctcttataaatagcatttaattcatcctgacaatctgatttttttttaaatatcttaactggagagtaattcatttacatttattgtggttactgataagtttgctctcttatgttttatttctctttcttttctttcaagttttgagttgaataaatttattcttcattttattattttctttctggtttgggagttatatattaattactacttttagtaaatacctttgaaattttaacattcatgcccaacctagtaaagatctgtaccctcatcctgaacaatatttaaaacaaggagttttaagtcagtgcttttcatgcttgtgctattgttattataattttagtgccatcttgtttgtttgataattctataaattcactgtttctgtcactgaatgttttcagtgtgtagatttatttccctgtttatcactattccttattgcatcttgatccttctatcaagtaaaatttttcttcttccaaaaatacatgcttgaaaaacttatgtggtaagaatgtatggaaggtaaactcagtttttgcccatctaagaatgttattttggcctctatcttcaaattttgttggctagacaattctagactggcagttatttttcagcactttgaagatattgttctgctttcttctggctgctttttctgtctcctgttgattgtttcctagaatttgaatgtatacgttccatgttgaactcaatttgtgagcttcctcctatttcttatgctggggatttgttgtggttggaatttgttgtaacctgcatccaatctggaaattttttgtggattcacagttaatacatttctcccttccacccagagccactaacccaagagagacaaatttgtttcctgtctgcttttgtaggtcagattttttttttcctagttgagtgaccttttctctgagagtgaagcctttgctgagttttagctttaagcagaggtttctccagtcttacttccatcctacaaaggcccaaggctttatggtccattcctctgagtgcagcagcctgtgaaaacagtagctctaggccattggtgtttagttgaaattccgagggctgtcagcttaagcacttactagtttcctgatattgttttgtttctaatctcagagtatttcttagtttcttgcaagctcatcagtttttaataggtatcatgcgtgagtgaatataaatttttacatatatataagagaggatttattttgttgtttacaagagttttggggggatctctaagtctcttcttgccttttaatggaaacgttctcgtcattttttttaatcaaaaaatcacattttgtttctcctgtgacttcttcctgtaggtgagcagtaggtcatccagtcccagtgtcagaatgattactacctcaggaccaacctcagaaaagccaactcgaagtcatccatggacccctgatgattccacaggtgaccagtctgtttcttcatacttatgaagttgaatcagtcatgtttatattcatttggccatgtcattactctaatgtttacaaaggcaggcattatactgttgtttagatttttatattaaataaactatttagtaatacatgttaaaataccattttgaatacagagacagagactgccttgccttctgtattttttttaatccagatactaaacatgtattttaaagattgtctgtttggggtttttttccagttgcgaagcgtattgaattcttgatacttcagcctgtgattttcctactagattcatcctactagatgatagtagtaaagtcattttttcagtaaccaaaatcggagaatggtaaaaatcatccccatcatcttcatctcaatcttttaaggacacgagatgtcatgtaccttaagttgaaaaaaattctgaccattgaccttttgaattgtttttaactgataagagacaccattttcagttatacaaatattctattagacctttagaaacctgtgatgagttattaaagctccccaacatgaataactaactgttcacaatattagtattaatgtctacctgcctaaaggtagtgacggcatcgtttcattatgggcaaacaggaaatgatgtgccatagtagaattaacttttccctaactttaagagaataccttgataaatgcttttaagtgtacttatgaaattttttatttatattatattaagtcacgaagggaaagatgatctcttagcccttggaaaattaaagcatttgatattttatataagatcgactatgttattaatagtaacaattagattgaagtttaaaagccagctttctgtctttacaaactaaaatacaactcaagtatttatagttatctgatgtggtttggtcaagtttataatttaatttaaaaaattaactgggtggtttttctgtgtgtcatgtaagatagaactatgtttagccagggtgtactctctagttttagtaagtttaaatttagtggcggcaaaaactcctgtttcacccctagcacagcccaacctaggactgtccagagcattcaccactacgcagcacatgtgtagaattcattatagacttgctcctccccagtggtagacagggcaatgctcttgcccagttttatcattaacattcaggtgatagcagctctttttgatttctgaaccccctggcaagggagtacgttctctgacattacagcatttgcccgggtctggtactcaactcagcagagccttctgtcttcagtctacactaatctgtatatgccagtcaatagtgtggcagattgtgacttcatgggggtaaaataaaaaatgtttaaggctctctctcacataactgctacatttctgcctcatatgttgcttctaccttccaactcccgtcccattgttttctttttctgtacctagaaacaccacaaaataccaattgctagaaataatttgcaatatcagctgaattttgtctttgccttgaaatatattgcacatgtgtggctataattttgaatacattttaaaaatggatgctctggtttaagtttataattaattcagctgtgcagtatttgtaagaaaaatattgataaccaagctaatagaataaattagggaacagataggtaaagtctttttctttgaaggcccactgaccaaggaaaaaattaagagtgtaaatgtaagttaaagtgacctaattaaatttttttaatttgagaggtttttgtatattttcagagaaagctaaagagcataacaatttaataatcatagccgataataagcgctcttcagttcctatttataatataatgggtattcaaaaagacacacatactgagaggatctagtgagagagagatctagacgcagtagagggagccgcagagggggaaactcactaaagaattttcacctttgcttagtactttgcaaacatgtattaatataaagtgtaagacatggcccattccttgcagtctggttagagtcataatactgacacattaaaagtaaacttatactatataataacttactaaatttatagtacaagctgagtgttttgatagttgtaagagaaatcagttcaacaagacttggcatagtctctggccttttcataaaatgatgagacttttctttagccataaagcagaaaggagaaggcagcattccactgaagggaatgcatactcaaagaatatgagatagtaacaagtgttgtgtttgaggggtcagaaaagagagtttgccttaatttaaccaaaccaacatgagctttgacattcaggagaagcaattagatttgattagcaattgaaacacacacacacacacacacacacacacacgcaaaaaactttcattaaataatcttccgatctgtgaccaattattgctagtagagattggaagttcaatatcaatttagtgtaaagtgagaaagtgaaatcccacttctttttttagagagaagatgaaattcaatgaaggaccttaagttccccaccatacaagggctttaattatttgaataacacaatccttggactttttttctgctcccagaataccacgcaacactgatgtattaagcttaattctaaaatacatatcagatacagggtgctgatataatgagatatataatgtatcagtgatttaagaaagaataataggaatggaaatcttaaattgaaactttttcaagacacttaaatttttctagtaaatcaggaggaaatcagtcatttttaatcagttttagttttgtggaaagcagtgtttatgtgggagcgtagtttgaaaccactgttggggtgggagaagagttggtcagagaaataacaaattaagtatatttcttgtttagccacttcagaaaaacacacatttatgttagtactgtatatgagccttaagggtaagggtaagtgccttaagtctctactgtttttctgtattgccctgcaatatttaataaacattactttttcaatatggaattcatactatactattttaaattgttctttctaattctccatttagtatgaataataatgataactaccgtcatgtattgagtgcttaatatacgccaggatttgcatggtgttcctcacatgcactggctcatttggtctgatttcgctaattagcttttggagtttcttgagagcacgttctcagtggctttaaaaaaacaaaaacaaaagcaaaaagaaaaaaaaacacctggattatcagttgacaataaattagaagattactgagccagcaacccttcttgagtttttttggattgcatacagtgcgtctgctgtcttcctgacttgcctttatccacaccactccttcaaggagttattcgtcagaaaaaggctgaagagctcactcatttagctctttttttgtctactaacagtgggaaagcaactacttctgaagtagaaaagtctgtattgcttcagagttactctgtttacttctggaactgttctacataaccataaatgttgagaagagactgtcccacgcatctcagtcaagttgtatggcagttttacctcttttgaaatataaacaaaagcattctattcaaataattttataaaattgactgattgtttgaattaatcaacttaactgttttcggcatgacattgagccacaggtttcaacctcattttggttccttactgttcgtatttgtaatatactctcatcaccaacatctcgttttctgcagtgattcttactgggaagggcaggatgagtggtggaggtcacattataatctatataaattgaaaatgatccactggaagagaatgtgtctctgctttctccctttccctgttaaggaacattgatattagcggagttgatatagccttctataaaataaacttagcatgataaagaaaagagatggggagtttgattagatagggtcaattaagactgaatttaaaatataaaggtctcatcactgtttttgtttttaattaagagcttagaagctctaatatattgtgttctattcagtttatagccaacttaaattataggtatgagaatataattgcattctaatatctgataattgaatatcctttttttaacctttagaattcagaaatagactcttcaattaccaatagctgtaacttttaatttacatattatttactttagggaaaaaaagcatttcattcatgctttcttgctgttcgtttataattatttgtgacagaaaatcaataaaatacatgcttgaattccagataccaatggatcagataactccatcccaatggcttatcttacactggatcaccaactacaggtaaaggagtactttcttattgaaagttgacttttttcttcttagagagtttaagttgacaattgtgttgctacctgtcattgtatagtcactccttaatttatccttttagttggcctccttaaactttttagaatcaaatcaaaataattcttttggttaagttaatcaaactttaaattggcagaatcatattcttatcttttcagtcatcttaaaatcctccagtatctttctttagtactgctaagcattacattttcactctttaattttagtgcattaaaacaaaactcataagcttatttctatttaatacatttgtgatacattctcatgttcatagtgactgaaaatgtaaataatatacttcagtgccccctcatgagtatgagggctataaacatcatttagtttgagcctgtttgcagcctgaaatgtcataccagagactacaactccaacaatcatgattctctgtaacagactgttaaaacagcaagaatagatttaaatgctgagttaattctgacaaaaggacactgagattttctagggcatggtttaacacttatttttaaaagatcattgctttagtgctataaaaatatatcacagtctctgtcttgactctcatcttagctagatattgaaatttgatttaattatgttttaacattcctgattattttcagcctctagcaccgtgcccaaactccaaagaatctatggcagtgtttgaacagcattgtaaaatggcacaagaatatatgaaagttcaaacagaaattgcattgttattacagagaaagtaagttattttttatgaataaaaataaaaatacattagtattttgagtttaaaatatgataaggtgcaatgaaaacgtagtttttagaattagtcattaagtatactttcaacttgtttaagctttaagcacccttttactaaaaattttttatgcaaaactcaatccttttgactatcatattagtgctatggaaaataaactggtgctttatacttgttgttttatgttctcagagctgtttagacttattattataaagatttattgttttcttgtaaatagataaaataatttgatttattaacattcagttgtgccttatcttagaaacatttttgtagatacattttttccaggtgtatgtttagaattggattacttattaaaagactgtatttcataactgagtgtttttctgaggagttatagaaactgccttcctccctttttaaagaaacacagcctaatttccttactactgcattcacagttcttaaatatgtatgtatcttcagttttcttaagcatgacctccatgaaattttatacttaggtaactgaattgttggtggtaactaaaatgaagtgataaggaaaaaattttggcaactttatatatgtatgataataggattcccttcattaattttaatctaaataaatgaaagttgtttttttctgaatttgcgaaaagctttctgtatgtacttcaaaaaaaagagagaaaaaattgttttatcataatttattgatacagtgatttaaatggaaccaacctggtatttgaaaggtaagcctaaataggaaattaaatactacagtttggaaatcgtagaagtaattatcaaactgctggcacttttatgttgaaaaagcttgatttcttatttcacttatttaacctatacttttgccatactttaatcatttgaaagaagtattctatgctggaaaaaacaaatggtggattagggtgttggctgtgaaaactatgacagttttaatcaattttaaatactttcagaagtagtattagttagttattttgcttgaggactttttattaattattcatttatatccagtaacctcactttaggaaatgcctaaagatgcatctttttcgggaatacttaatagttcccaaataagagggacttaaataagtttatcagactataaaagaatgagggtctttcctgaaagtgcttgcaaatgtaagtgttttaaaagaagtggtactttgtcatttttctcactgctttaaaatgggaaaaagctttaaattggatagcatttattttaattagattgcaaatttgctattagcttaccactctctgctatagttaagtaggattgtgacttcagaatgtgaatcagtataaaagtagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagc

SEQ ID NO: 12867 - DNA, 399 bp, Homo sapiens
ttaagtaacagtaagttaatagtaacgtatacagattttataacataacactcataaagctagcaactttatagatttgtaaaaaggcagttgaaatgaccactgcagcttaatagttaatagttctttttggtgtctagtactcagaaacctgttggaaactaattttgtgtagtttgatatccattggccaaattaccatttgaatttactaaagaattcattgcttcactactgtgccatagtttataaaggactttttgagtgctctttgattcttgtctctgaagaatcttagcataatgccaacatagtgccaaccataatagttttccagttaagtacttcctatttctatctaaaaggcttggcatgtgtttaaacaaatattaagttcag

SEQ ID NO: 12868 - DNA, 150 bp, Homo sapiens
gtggtggcaggtgcctgtaatcccagctactcgggaggctgaggcaggagaatcgcttgaacctgggaggcagaggttgcagtgagccgagattgctccactgcactccagcctggacgacaagagtgaaactccatctcaaaaaaaaaa

SEQ ID NO: 12869 - DNA, 140 bp, Homo sapiens
cttctttgtttacctaatcaagcctgggcaatggcgggcgcccctcccccagcctcgctgccgtcttgcagtttgatctcagactgctgtgctagcaatcagcgagactccgtgggcgtaggaccctccgagccaggtgc

SEQ ID NO: 12870 - DNA, 2962 bp, Homo sapiens
gctgacacaggagaattgcttgaacctgggaggcagaggttgcagtgatctgagatcgcgccattgcactccagtgtgagctacaagagtgaaactctgtctcaaaaaaaaagactacacattgggtacagtgtacactgcttgagtgatgggtgtaccagaatctcagaagtcaccatttaagaactttttcacgtaactgaacactgcctgttccccaaaaacctattgaaataataaataaataaataaaacaaagttatggttccaatcatcagaacatagtatagtaaaattaatataacaaaaattaaaagatggataaccacatgaaaattaaaattccgcacatgtaaagcaaaagagaaatctataaacaataagaggatggcttgtaatcaatgaactttataatgatgtagttatattttcatgagtttttactaaatctgtatttaaagaaaactttatcagtttaaatgtctatattagaaaaagagaaaagaaatatagaactataaatgtctcaaatagggaaaatataattaataaaattaagcagaaataagcaaaatgacagtagttgattctttgggaaatttagtcaaagtcataatcattagattagttagacaaagtaaaatgtaaataggatcaggagaagaggtacggtaacatgcaagaaaactgaaatatttgggagaatgttatttttagttagataatgttaattaatagctcaggtcaaaatcagaagtaattaaagtatatgtgtgttgaggggggaggggaattgctagagtggatgcagctaggagtagaaattatagctagaatgaagcttctcaaattactaatttacaaattacaaattactaaattactttagaaagaagtaaggtataaataaatcaaatttaaaaaactattagaacccatagagtcataataaattagcaaagaaaaggacgcctagccctgatgggatttaatttggagaattttttcagaagttcagagaacaattgcctagttactaattagttctaccttcaaaatgtagaaaggtatgttattaagtttctgattcattttacaagcataaatgattttgttttgacaatttgataaaaacaataactttaaaagaatttatggactggggtcattaattgacaatacgatattatattacagtaattatttactgtgagcaagttaattatcctcaaatgcatgagcagcatcataaaagaaaagctattaaaacagaagaggaaatttaggactcatcttcagttcctctttccttcacttctgtgtcctattcatgaaaaaatcttgactgctttaacaagtacattaagaatctgtgggcttctcaacttcgccactgctcctttcctagtaaaagtcaccatcatctcctcccaagttaccgcagtcatttcctgttgtcacttttcacctcacgatgtcacgtttcacctcaactcctaacaacctattttcaatatgtagccagagtgatcattgtaatgtcctttccttggttaaaaccctctagtggcttctcatctaacttagaataaaaatccagactcttcctatgtcttccaggcacgtaatttggccactgcctagctctccaacttcaccacatgcccctttccttaggctttccttggtttaggaaacatacaagaccagggtatgtcccccattaagctagtgtcctccttacagctcttctacttgctgatttctctgtctgaaacattcttccctcagttctttaggcaaatgtcactgtcctggggaggctttctttgatcccataatcttaaatcgcttcccttccatgtactcattgtccgtccaacacacctcactctttagtttcttcatgtacttaactaaaattaccttatttgtttattggcttttaccctagtgtgtaaggcctttgtacactgctgtatccatagtacctatgagaagttgagatgattagtgaatattagttaaatgattgcatgatgtgtaataataggcaggataagcaatataatagtgggtgaaaaatagaaaaattggcagtagaattgaacagtccttccactcccttatagaaatttagcatgtaggacattaatagttggtaacgggagaaagatggtcgcaggaaatagtaatataaagataacagtggtcttaggagtcttcggttttaattctgactcagccatgtaacttggagaaagttacctaatccaacctttagttttcttcatatgtgaaatcaggatagcaatatctcctagatgttggatgtacatacttgtgcatttctgtaggtaaggtcctgctgtcttctttgccttgtccccctctctttggcatagacattttaatgataagtattttatgtcaggcccaagatttcaaaagtggttcaaattccaatgtcaatttagatgtgtaaaatacctcacgcagtgaaaggcacatagaaagtgaacagtagatgttagtttctttcactcatagttgtagtctttaggctggctaattctatatttaacttcaaatcttcctcaggattctcagaaccatatattcttgctattaaaatacattcctgctttttcttaaaccataaactcctaagagtattttctctatgacatttatcataatgatttattcatagctggtgttctataaatgtttgtttaaaatttagcatgcgtttgttaagtgcctgttatgtgcagtgcgtggagttaaacacagaaaacaaagtaaaggaagtggaaagacatattctagctatatggtaggaaaattttgctcacttttgaagagatgaagatatatttaataagatagattagaatttataaaaataaaaagacattggcgccctgaaatatataaaatgaatatggaaaggaaagga

SEQ ID NO: 12871 - DNA, 88 bp, Homo sapiens
cctcgctgccgccttgcagtttgatctcagactgctgtgctagcaatgagtgaggctccgtgggcgtaggaccctccgagccaggtgt

SEQ ID NO: 12872 - DNA, 411 bp, Homo sapiens
actcaatgcttgccccactgtgttggctctgggatatacacttcttacctagacgtttatttttactcacaggatttactaaaccttaggagctgagccaggaatggtggtgcatgcctgttgtctcagctacttgggaggctgaggtgggagatcgatttaacccatgtgtttaaaaccgaacggagctatgatcatgccactgcactccagcctaggcagcagagtgacagcccgtgaagaaagagagagagagagagagagtgagagacagagagagacagagagagagagaccttaagagctgaatccttatcaacggattctaatgaaaggccatgcttttctccaaaatgctggatgaggccatctgtctactattcttgttaataaaaataatgagatgctgct

SEQ ID NO: 12873 - DNA, 560 bp, Homo sapiens
tttctttttcttacatacctaggcaggggaaaaaaatcattagctaagtcaatcaaggggatctgagagccaaaggcattcaatgtaaaaatgagatgcttaattgcttaatttctgcagaattgaatacaccaccttttggctacacctacacttacatgtgtcggaattaggcccccaagagcccccaaagcagcaaatgcttacagaaatagcaaaatcttactaaaggtaatttaaaattacagtggaacattccaaataaataatactgtacttttaaatgtgtgttattgtagcagatttcacacacacacaaagtgcattttaaaatgagggctcctaaagaaggctcttccagggatgcctaccgatgtgcagaaacttctaaaaagatttcaatacttttattccctcattaaaaaaaaaaaaactcttggccaggtgtggtggctcatgcctataatgccagcattttgggaggccaaggtgggcagatcacttgaggtcaggagttcaagaccagcctggcctacatggtgaaaccccatctctagtaa

SEQ ID NO: 12874 - DNA, 228 bp, Homo sapiens
ccaggcgcggtggctcacgcctgtaatcccagcactttgggaggccgaggctggtggatcacgaggtcaggagatcgagaccatgctggctaacacagtgaaaccccgtctctactaaaaatccaaaaaattagccgggtgtggtggtgggtgcctgtagtcccagctacttgggaggctgaggcaggagaatggcgtgaacctgggaggcggaacttgcagtgagcc

SEQ ID NO: 12875 - DNA, 308 bp, Homo sapiens
tttttttttattgtactttaagttctagggtatgtgtgcacaacgtgcaggtttgttacgtatgtatacaggtgccatgttggtgtgctgcacccattaactcgtcatttacattaggtatatctcctaatgctacccctccccccttcccccaccctacaacaggccctggtgtgtgatgttcctcttcctgtgtccaagtgttctcattgttcaattcccacctatgagtgagaacatgcagtgtttggttttttgtccttgcgatagttttgctgagaatggtggtttccaccttcatccatgtc

SEQ ID NO: 12876 - DNA, 544 bp, Homo sapiens
cattcttcctcccttcctttccatccccttcttccaacaaatcccccacaatctatttgtgcacagtctttggctgcatttaagaaaggtgtgtgttcatgtcacaggaatgcttgatcctagtgtactctgcatttgatcaatgaaaaactgcagtattctgtttagatctgacattgatatggacaaatgtgatgcactatagtaggacagatgggctgctcagaggactggaagccatgtcaccagaagagtgaatgggcagctgtgggtatactctgaagaaagaaagacccaaagggtcatgtgtccacatatttgaagaagtatgtagagtacaatgattaagagcatgggccctggggtcagattgcctagggtcaggcctttgaaaggagttagtggagacaggcaacaggctctcacactctttttgaagacttgttcaaaatatctaaagaaaagggatatgccatgtcaccctcctcttgtgtatttactgagcctgacacatcataggtatgtaataaatgccttagcttcc

SEQ ID NO: 12877 - DNA, 105 bp, Homo sapiens
aggctgaggcaggagaatcgcttgaacccaggaggcggaggttgcggtgagccgagatcgcaccattgcactctagcctggacaacaagagtgaaactccgtctc

SEQ ID NO: 12878 - DNA, 557 bp, Homo sapiens
tgtttttatttatttattttttaaattttattattactatactttaagttttagggtacatgtgcataacatgcaggtttgttacatatgcatacatgtgccatgtaggtgtgctgcacccattaactcgtcatttagcattaggtatatctcctaatgctatccctcccccctccccctaccccacaacaggccccggtgtgtgatgttcttcttcctatgtccatgtgttctcattgttcaattcccacctatgagtgagaacatgcggtgtttggttttttgtccttgagacagtttgctgagaatgatggtttccagcttcatccatgtccctaccaaggacatgaactcatcattttttatggctgcatagtattccatgatgtatatgtgccacattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatggctgggt

SEQ ID NO: 12879 - DNA, 330 bp, Homo sapiens
taatttactattatcaagtcagtggaagtagaatgttagagctatatagtctagttacaatttgatttcattcaaagtgactggtatgttttttcaaaatgaaggccaaactgacgaacagcactcagcccctacttcacaggcacccagatctcaagaatgtaatgaaaccaaaagtggtgtttcccttcagttttgtttgcatctctggataaaatggacttggctgaaatgtgttgaaagcttaaaaaaatgtgtaataccaccatcagttttctgggctccttgaagatcttttaaaacttaaaatttgggttttaattttttttt

SEQ ID NO: 12880 - DNA, 535 bp, Homo sapiens
aaagacagcactaacctctgcagacttaaatgtccctctctgacagctttgaagagagtggtggttctcccagcacgcagcttgagatctgagaacgggcagactgcctcctcaagtgggtccctgacccccgagtagcctaactgggaggcacccccgagtaggggcagactgacacctcacatggccaggtactcctctgagacaaaacttccagaggaacgatcaggcagcagcatctgcggttcaccaatatctgctgttctgcagccaccactgcagatacccaggtaaacagggtctggagtggacctctagcaaactccaacagacctgcagctgaggatcctgtctgttagaaggaaaactaacaaacagaaaggacatccacaccaaaaacccatctgtacgtcaccatcatcaaagaccaatggtagataaaaccacaaagatgggaaaaaaacagagcagaaaaaccggaaactctaaaaatcagagtgcctctcctcctccaaaggaacgcagctcctcacca

SEQ ID NO: 12881 - DNA, 1004 bp, Homo sapiens
tgcccccagaggtggagcctacagaggcaagcaggcctccttgagctgtggtgggctccacccagtttgagcttcctggccactttgtttacctactcaagcctgagcaatggcaggcgcccctcccacagcctcgcttccgccttgcagtttgatctcagactgctgtgctagcaatgagcgaggctccgtgggcgtaggaccctctgagccaggtgcgggatataatctcctagtgtgccatttgttaagcctattggaagagcgcagtatgagggtgggagtgacccgattttccaggtgccgtctgtcacccctttctttgactaggaaagggaattccctgaccccttgtgcttccctggtgaagcgatgcctcgccctgcttcatctcatgcacggtgcgctgcacccgctgtcctgcacctgctgtctggcactccccagtgagatgaacccagtacctcagttggaaatgcaaaaatcacccgtcttctgcatcgctcacgctgggagctgtagactggagctgttcctattcggccatcttggctccactgctgaattcgcatatagtacttttaaatgagaaataaatagccatgaataaacaattctgtcatacaaaagggggaagaaacttttttgtaatttgactttgcagaaaataaaaccccagtgtcagagcctgtcactgtgatctagttctaggaaggtattctgggtttattttccattcttgtctcttggtgaatactgtatttcaaccactatgccttctttgctctctaaatgtaccctgtaatttctgtctctctactctagctcaggggtctctgagctctggatctgtatgtgtatctgtcaatgaacatctatatctggatatcttccaggcacctctggtctaaaacacctaaagcctaactctttaatgtccccatttctactttaatctttatccaggttcctgcgccatcatataactagttgcttaagacaaa

SEQ ID NO: 12882 - DNA, 89 bp, Homo sapiens
ctcactgcaacctccgcctcccagattcaagtgattctcctgcctcagcctcccgagtagctgggattacaggcgcctgccaccatgcc

SEQ ID NO: 12883 - DNA, 421 bp, Homo sapiens
agtggttgcttggctataggctgaagcaatggcgtgactaggcctagaacctttccttgtttagtaagctaaccccagcttgctcccagggtggcagggtcccaagaacagcaagagagcaagctccagtgcataagctcttttcaagtctttgcctatattatgtttgcttgtcctgttgggcagagcaagtcacctggccaagcccagtgtcagtatagagggcactaccaaatggtgtggacacagcgaggcagaaaaagagctgagaccattactattattattccaccacaacttaactgcttgattcagtattctgacgtgaactcagggttatctgaaaactttctcctgccgtaataaatctgtgaatggagcataatcatgtctgaagttgcatagagccctctgaaccaca

SEQ ID NO: 12884 - DNA, 136 bp, Homo sapiens
tttttttttttgagaccgagtctcgctctgtcgccaggctggagtgcagtggtgcgatctcggctcactgcaacctccgcctcccaggttcaagcaattctcctgcctcagcctcccaagtagctaggactacagg

SEQ ID NO: 12885 - DNA, 145 bp, Homo sapiens
cctgtagtcctagctacttgggaggctgaggcaagagaatcgcttgaacccgggaggtggaggttgcagtgagctgagatcacaccactgcactccagcctgggcaacagagcgaggctccgtctcaaaaaaaaaaaaaaaaaaa

SEQ ID NO: 12886 - DNA, 450 bp, Homo sapiens
ttctagatctttgagaaatttccacactgtcttacacaatgtctgaactaattgacactcccactgaatggtattgcctaggttttcttctagagtttttaggattttaggttttatatttaagtctttaatccatcttgagctaatttttgtataaggtgtaagaaaagggtccagtttctgttttctgcatatgcctagccaatttccccagcaccattttttaaatagggaattctttacccattgcttgtttttgtcaggttggtcgaagatcagatgattgtagatgtgtggtgttatttctgaggcctctgttctgttcccttggtctatatatctgttttggtatcagtaccatgctgccttggttactgtaaccttatagtatagtttgaagtcaggtaaagtgatgtctccagctttgttttattgcttaggattgtcttg

SEQ ID NO: 12887 - DNA, 250 bp, Homo sapiens
ctgtaaaggattttatttctcctccacttatgaagcttagtttggctggacatgaaattctgggttgaaatttcttttctgtaagattgttgaatattggtccccactctcttctggcttgtagtgtttctgccaagagatcagctgttagtctgatgggcttccctttgtgtgtaacccgacctttctctctggctgcccttaacattttttccttcatttcaactttggtgaatctgacaattatgtg

SEQ ID NO: 12888 - DNA, 278 bp, Homo sapiens
tcccagcactttgggaggctgaagtgggcagatcacgaggtcaggagatcgagaccatcctggctaacacagtgaaaccccatctctactaaaaatacaaaaaattagccaggtgtggtggcgggcgcctgtagtcccagctactcgggaggctgaggcaggagaatggcatgaacccaggaggcggagcttgcagtgagtcgagattgcgtcactgcactccatcctgggcgacagagtgagactctgtctcaaaaaaataaaaataaaaatacaaa

SEQ ID NO: 12889 - DNA, 734 bp, Homo sapiens
aaaaaaaaaacaaggggctggggagccaagatggctgaataggaacagctccggtctacagctcccagcgtgagcgacacagaagacaggtgatttctgcatttccgtctgaggtaccgggttcatctcactagggagtgccagacagtgggcacaggacagtgggtgcagcacaccatgcatgagccgaagcagggcgaggcattgcctcactcgggaagcgcaaggggtcagggagttccctttcctagtcaaagaaagaggtgacagatggcacctggaaaatcgggtcactcccaccctaatactgtgcttttccgacgggcttaaaaaatggcacaccaggagattatatcccgcacatggctcggagggtcctaggcccacagagtctcgctgattgctagcacagcagtctgagatcaaactgcaaggcggcagcgaggctgggggagggatgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttcttccagcatgcagctagagatctgagaacgggcagactgcctcctcaagtgggtccctgatccctgatccctga

SEQ ID NO: 12890 - DNA, 484 bp, Homo sapiens
tccgtcaaaagtaaatggatcaaccaactgtggtatattcattgtatggaatgctactgagcaattaaaagaatgaactgatatacattacaactgatggatctcaagtgcatcatgttaagtgacctatgccaaagtcaagtgacttaatactatgttattccatttgtatgaaattctggaaaagtcaaaactatcatcataggaagcatgtcagtagttgttaaggactggtggtattgactacaagagggtccagggaatttgggtatggggggaatgagggaactatcctgtatcttggttatggtagtgctcacaaacctatgtgcatttgtcaaatctcacagaattgtatactaaaaatgtgaattttactctgtataaattgtgccttaaataaatgacaaaaaagaaaaaaaagccctgagttttaactgcagtaggtgctgaagcaagaatagtgtcactaaaccaaaaaaaa

SEQ ID NO: 12891 - DNA, 686 bp, Homo sapiens
cagttcccaaataatacttttataatttcttatgcctgtctttacttcagtctattaatcctgttatctttgtaagctgaggatgtaggtcacctcaggaccactgtgataattgtgttacctgtacaaattgattataaaacatgtgtgtttgaacaatatgaaatcagtgcaccttgaaaaagaacagaataacagcgatttttagggaacagaggaagacaaccataaggtctgactgcctgcggggttgggcaaaaatagccatatttttctccttgcagagagcccataaatggatgtgcaagcaggagagatattgctaaattcttttcctaacaaggaatattaatattaataccctgggaaaggaatgcattcctgtggggaggtctataaatggctgctctgggaaatatctgtcttgtgcagttgagataaggactgagatatgccctggtctcctgcagaaccctcaggcttactagggtggggaaaaactcagccctagtaaatttgtggtcagactggttctctgctctcgaaacctgttttctgttgtttaagatgtttatcaagacaatatgtgcaccgctgaacatagacccttatcagtggttctgcttttgccctttcccttgtgatctttgttggacccttatcagtagttctgcttttgccctttg

SEQ ID NO: 12892 - DNA, 169 bp, Homo sapiens
ggtctgagagacagtttgttgtgatttctgttcttttacatttgctgaagagtgttttacttccaattatgtggtcaattttagaataagtgcattgtggtgctgagaagaatgtatattctgttgatttggggtggagagttctgtagatgtctattaggtctgcttg

SEQ ID NO: 12893 - DNA, 169 bp, Homo sapiens; identical to SEQ ID NO: 12892

SEQ ID NO: 12894 - DNA, 164 bp, Homo sapiens
tttttttttgagacggagtctcgctttgttgcccaggctggagtgcagtggcgcaatctcggctcactgcaagctctgcctcccgggttcacgccattctcctgcctcagcttcccgagtagctgggactacaggcgcgcgccaccacgcccggctactttttt

SEQ ID NO: 12895 - DNA, 642 bp, Homo sapiens
ctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaa

SEQ ID NO: 12896 - DNA, 440 bp, Homo sapiens
cttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaa

SEQ ID NO: 12897 - DNA, 252 bp, Homo sapiens
tttttttttttttttttttttttttttgagacagagtctcgctctgtcacccagcctggagtgcagtggcatgatctcagctcattgcaagttccacctcccaggttcacaccattctcctgcctcagcctcccgagtagctgggactacaggcacccgccaccacgcccagctaattttttgtgtttttagtagaaatggggtttcaccgtgttagccaggatggtctccatctcctgactttgtgatctg

SEQ ID NO: 12898 - DNA, 1661 bp, Homo sapiens
tgtaaatttgtttaagttctttgtagattctggatattagccctttgttagatgagtagattgcaaacattttctcccattctgtaggttgcctgttcactctgatgataggttcttttgctgtgcagaagctctttagtttaattagacgccatttgtctattttggcttttgttgccattgcttttggtgttttagtcatgaagtctttgctcatgcctatgtcctgaatggtattgcctaggttttcttctagggtttttatggttttagttcttacatttaggtctttaatccatcttgagttaatttttgtataaagtgtaaggaagggatccagtttcagctttctacatatggctagccagtttttccagcactacttattatatagggaatcctttcctcattgcttgtttttgtcaggtttgtcaaagatcagatggttgtagatgtgtagtgttatttctgagtcctctgttctgttccattgatctatatatctgttttggtaccagtaccatgctgttttggttatgtagccttgtagtatagtttgaagtcaggtagcttgatgccttcagctttgttctttttgcttaggattgtcttggctatatgggctcttttttggttccatatgaactttaaagtagctttttccaattatgtgaagaaagtcattggcagcttgatggggatggcattgaatctataaattaccttgggcagtatgactgttttcacaatattgactcttcctatccatgagtatggaatgttcttccatttgtttgtgtcctcttttatttcattgagcagtggtttgtagttctccttgaagaggtccttcacatcccttgtaagttggattcctaggtattttattctctttgtagtaattgtgaatgggagttcactcatgatttggctctctgtttgtctgttgttggtgtatgggaatgcttctgatttttgcacattgattttgtatcctgagactttgctgaagtttcttatcagcttaaggagattttgggctgaaacaatggggttttccacatgtacaatcatgtcttctgcaaacacagacaatttgatttcctcttttcctaattgaataccctttatttctttctcttgcctgattgccctggccagaacttccaacaatatgttgaataggagtgatgagagagggcatccctgtcttgtgccggttttcaaagggaatgcttccagtttttgcccattcagtatgatattagctgtgggtttgtcataaatagctcttattatttatccaggaatttatccatttcttctagattttctagtttatttgtgtagaggtgtttatagtattctctgatgtattattgtatttctgtgggatcagtggtgatatcccctttatcattttttattgcatctatttgattcttctctcatttcttctttattagttttgctagcagtctatgtattttgttgattttttcaaaaaaccagctcctggattcattgattttttttgaagtgtttttttgtgtctctatctccttcagttctgctctgatcttagttatttcttgccttctgctagcttttgaatttggttgctcttgcctctctagttcttttcattgtgatgttagggt

SEQ ID NO: 12899 - DNA, 828 bp, Homo sapiens
ttttttttgtttttgttgtttttgctttcttttttttattatactttaagttctagggtacatgtgcacaacgtgcaggtttgttacatatgtatacatgtgccatgttggtgtgctgcacccattaactcgtcatttacattaggtatatctcttaatgctatcgctcccccctcccccaaccccatgacaggtcccggtgtgtatgttccccttcctgtgtccaagtgttctcattgttcaattcccacctatgagtgagaacgtgcagtgtttggttttttgtccttgcgatagtttgctgagaatgatggtttccagcttcatccatgtccctgcaaaggacatgaactcatccttttttatggctgcatagtattccatgatgtatatgtgccacattttcttttctttttttttcttatactttaagttccagggtacatgtgcaaaacgtgcaggtttgttacatatgtatacatgtgccatgttggtgtgctgcacccattaactcgtcatttacattaggtatatctcctaatgctatccctccccccttcccctaccccacaacaggcctcaatgtgtgatgttctccttcctgtgtctaagtgttctcattgttcaattcccacccatgagtgagaacatgcggtgtttggttttttgtccttgtgatagtttgctgagaatgatggtttccagcttcatccatgtccctacaaaggacatgaactcatccttttttatggctgcatagtattccacagtgtatatgatgtgccacatattcttaagccagtctatcattgttggacatttgggttg

SEQ ID NO: 12900 - DNA, 424 bp, Homo sapiens
tggtctttgatgatggtgacgtacagatgggtttttggtgtggatgtcctttctctttgttagttttccttctaacagccaggaccctcagctgcaggtcattggagtttactggaggtccactccagaccctgtttgcctgggtgtcagcagtggtggctgcagaacagtggatattggtgaaccgcaaatgctgctgcctgatcgttcctctggaagttttgtctcagaggagtacctggccgtgtgaggtgtcagtccacccctactggggggtgcctcccagttaggctactcaggggtcagggacccacttgaggaggcagtctgcccattctcagatctcaagctgcatgctgggagaaccactactctcttcaaagctctcagatggggacatttaagtctgcagagtttattgctg

SEQ ID NO: 12901 - DNA, 533 bp, Homo sapiens
gttttttcgctttgttttttccccatctttgtggttttatctacctttggtctttgatgatggtgatgtacagatggggttttggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaacaacaaatgttgctgcctgatcattcctctggaagttttgtctcagaggagtacccggccgtgtgaggtgtcagtctgcccctactggggagtgcctcccagttaggctactcaggggtcagggacacacttgaggagtctgtccgttctctgatctcaaggtgcatgctgggagaaccactactctcttcaaagctgtcagacagggtcatttaagtctgcagaagtttctgctgccttttgtttggctatgccctgcccccagaggtggagtctacagaggcaggcaggcctccttgag

SEQ ID NO: 12902 - DNA, 608 bp, Homo sapiens
tttttttttttctgagacagagtctcgctctgtcgcccaggctggagtgcagtggtgtgatctccgctcactgcaagctccacctccctgggttcacaccattctcctgcctcagcctcccgagtagctgggactacaggcacccaccaccatgcccggctaattttttgtatttttagtagagatggggtttcactgtgttagccaggatggtctcaatctcctgaccttgtgatctgcctgcctcagcttcccaaagtgctgggattacaggcgtgagccaccgtgcccagccttggatgggcttttgatgaactatctctgcctcaagaaccactcccaaaacttagtggtttaaacaacaaccgtgactcttgggttgactggggctcagcaggccagtgccttttcactttgaagatggtgctggatacttgtgctgctccatgtggcatctggacctctggggcttctccacattggcctctttctctatgctagacttttcacatggtcagcctggggctccaagagaaagaattagaagtggtcaggctttctcagtgcctgggcttgcaagtctcaggatggtgcttctccacattttt

SEQ ID NO: 12903 - DNA, 275 bp, Homo sapiens
gaagagagagaaaagaggttgaaggaaaggaagagaggttaaaagagaaagagagtgagaaaagagggaagttttattttctaataccattacagaaatattttgtgctcatatttgacttccaacttttaaatcaaggttcattagacaaagattattaaccagtttcaatgaagcctcagttacctccagccttaaatacagacagaaatatttgggaaacataccattttgttcgagagttaaggattcctaatttaagtatataagctttt

SEQ ID NO: 12904 - DNA, 150 bp, Homo sapiens
gctgcacccactgacccgcgcccactgtctggcactccctagtgagatgaacccggtacctcagatggaaatgcagaaatcacccgtcttctgcgtcactcacgctgggagctgtagactggagctgttcctattcggccatcttggctc

SEQ ID NO: 12905 - DNA, 188 bp, Homo sapiens
atggctcagattatgtgtcagccttgatgttcatgaaaacctagaatgataagatcatgttcctcaaggaaattccagatcttggttagtctatcttgtggttaaaaagatccttaaagtagagcaatttgaaactcttaataatctttaatagtgtttccttttaattaaaaatatattcttcctga

SEQ ID NO: 12906 - DNA, 6115 bp, Homo sapiens
ggaaatggaacaatagacttcaatgaatttcttctcacattaagagtaagtggccccattaatcagtgtatctgctgagtttggctttcacgtagtttgggttggctaccttgaggttttgtttttacaagttgttagtacactgtggggagggggataagcagaaaactgtgaacagacttaggaatttttggagcaattgtagtgtctattacataatagcacacaaatattatttcacatcgttgaggggaatgagatattttatcacataggataccaaaaaagctcatttgcttatgtatgtctctgtatgtattcttctatttttgtagcctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtaagtaaaagagcctaatctaggggaaatttcttcaattcgaaattgtaaatgggaaataggtccaaactcttaaaaatgttaacacattgataccatatttgttgtaaatagaagtaaactatttccctaggaacaatctagaaacttctccattgccaggggaaaccttcatgttactttagttgaaacctaatgtatgtttgtgcacgcacacactcatagacatatattgaaatatattggtaggggatccacataagtgatgacctgtcatctggggaatgtgatgttctgattaaacatgccattttatggttactatatttaccatactcagctagttgcactccagtgaactgattataataaaatatatttaactttgaaatgagatcataatttaattttggagaacagatttacaaggcctttcaggatgttttagcgccttcacactcatcctcattcatcttcacactttgctatgtggaaatgccatttaaaggtagtttttggtaaagggaatgtcaaataacagaatttactctgatttattctttagtgtgctttgagattaacttacatttctaaactgcactgaatttgaaaacaaaatcaaccgcccatctccattaacttttatcttcaagttacaaatgcatagcttggtagggtaaggaattatatagctccatgactgtgtctaggctgagatgaaaatgtcatctgtcctttatcaacagccctaaattgactttttagaaaaaaaaaaaaaccctgagccagttctgttcttagatgatctaagggttttggtgataaggaaaggggattgtcccttgagtaacagtcagcagcagcacagccccagggttcattgtctcttaagccctttacagcacaggaaaagataagtggcccagtggacaagaagagagtggttaagggaagaagaaataaaccttcctcttctgaagggaatgtgctccaactttttaaatgaaacttcatgatgagtctcattagcaaggggtgggggataggaaggtgacctttctgttcttcctgctgacatttccctttcagggatggagacataccctctatttcaggctgaggattgtggaggcaggtttacaaaagggccaaaattcaatagggcagccaaaatcttagggacagaaataaaaactacatgttttcttccagtattgctggccttgatcactgagatgtcagtggaaaaatagccaactgccatttccccaaattagcccacccctttgtggatcctagagtgtgtctgcttcctctctgcaggtggttcctcctcattgccaggggaaacctcagctacccttttctctaacaaaagtcaaaatagccagttgtgattcggctgattcaagtctgcacatcaccccttttgatatttatcttaagaagccacattaagctctcaaaagctcataaaggttattgaggtttttagcagttatagcacttgatgtcatctgcatgttacagaccctgtattgatacccaactctggctgttcataatcatcatcagggaggatttattagtaatgtagattcctagctgcactgcagaaccacagaatctgattttttggaggatggagtccaaggctttacattttaatgtataccagatgactcttacactcacgtgtatttgtgatccttagctctaaaagattcagaaataactgttttaaaattactaaatataatatacacatgaccccatttagcataataatgaatctgggcaacactttttgagcacatatcaactgggcatttgctaagggcttaccagggatatctcatttaatagacataataaaagtgtttctgaaaagtgatgtgtaattcaaactttcgcacactgaattgtattttaaatgcacaagaaattgttgttgtagaggaactccatggtaaattcttttatgagaagaataattagcttctaaaatttacctcttgcaaattgcactattttgcatattaagattgcttgtggtgaagcatagctgtacttgaagccagtgtgctcatttatggttaaaaacatcccatataagacaaaatttaaaataatgcaaaaaatttagcatagctcctagctaaaggtaatgttcaaacttgataatctaggttaaactctcaaatacccataaaggttgctggagtttcagcagtcacggaatttgatgtcataaatcttgcactaatacctcactggactcccatagcagccggaagccatttggatggaggtgtgaagcaatcagataacctgtgacacagactttccttaccccttttctatcactaaaccccaccacaatttggtgagacatttacttcttattctttaatatctaagttttgaattcttcatgtgtatatatgactttatcatcactatatttttaaaaagcctcttaggactttagaccttcagggaatatcagtctattgcctcatccatctcataaaaaatttttaaataattaaaaatatgttaggtatattactgagtgtatgtattaatagtaacctagatttgttttaggatttttctgatgaatttggagctgagaaaaagggcttgtattgtgacttccattacccccatctgggacctttccttgtatatatgatatatatcttgtcacataaaggtagcctagtcaagaggcctgctaaaagtaggagtgcccagtctctcatttttttctaatgtcaaataaaatgaataaggatagtgattattgctaaccaacaatttactatgatgagggcaaatttacaggagatcagagaatttgcgattcaggccattcccaatataagttgagtctcagaaaacaagcaaacacctagctaagagtaactgatggctttttctgaaatgatcaaatacattagctctgacctctggcttgacatcatctgacttccaagtgaggtttaatgcttcctttatcttttgcccatcttggattccttctccattctccaacagagccaactcaactcaggtcaccccatcccactgggggagtttgggatggaaggatgggtgacgataccagtctcaatcatgtattggtgtttcagttagggtttgctttcaattgcaagaaataggaaatcttattatacactggaatacacaaattaggttttattttttattctacttgatgttctcacttgagtggcttaaagagagcagagctgaagtctttgtgattttcctggcctttccttcatgatctcaagatggttgcctaacttcagccagcacatctgagtttcaggcagcaggacaaaggagggagaaggagggaacgagaaagggctggagcctgcatcaggaaagcaaaggcttccctagaaattcatgtcaaatttcctttgtatcttattggtgagaaatctattacttggccatcccaagctgaagctgcagaggagtctgggaaagtgagttttgagtttttcaacttctgtgggagagaaaagctagggataggattattacagtggatgtggagggagtctcactcaatggctgtcatccctggccaacaaacagacaatagaaacaataacaaactaaaaatatcgggagtttgataatttttaattaaaaaataattagctgtaaaaaatgttcctcaaactgtcacggtaaagtgcaccgtcaaaatggctcagggtctcgtgggtaactcttttagtttacttgctatttgctgtaaaatgatccacttactttgttggagtatttcaccagcctgcaactttttgaggactgagactttatcttaattatctttgatattcccagttaaattactgtagtgtgcacaacaattaactgggatgtttagatttttaagaagtaaattccacaaccacctgcttcagagattctgatttagcaggtgtggggtacagcctgtgggcctaggcttatgacagacaccccaggttgtcctgatgcaggtggtgtggacccacactgataaacatttccctggaacctcacacaacatgagaaagatagaaagagggcaataatgatgtgtgaaacttaatgtaatcccttaatgagggaattgaaaagcagaggctgaggaatccaaaggaggagaggaataaagaagttcaacaaagggggatgctaatggtatcctaattttgacagaggctctatgcatgtattgtagatgtgtatttacagttcaactatgagctgagttcaaatgcctttctttctactgcccttccttatgtttttagtgggaaggggtggtatgaaagacaactgtggatccagtgacttttcttttctggtcacttataatttcaataggaccagtgggtcagtcatctcttatgattcttggaaggcataggtatgtccccaaccgatcatgtcaaccaacatgattaaattagagtgtacatattatctagacctgttaaaaataagactaataactgtcttttctccttccccaaaggaaagtaatataaaatccccacacagataaacacattagtcaatatttcaaagagatggtcatgggtgtagagtggagagaagccaggatgggtgggaggcatgaagcaggggtaagctttttattcaccctgggccttgaatgagttatttatgtgttagaaaagcatgcaacccgggagcgtttaactagaaatctgtttcttcacccacaggagagaactccatttttggaaagggaaaacatcacttaccctgacacaaggacatgacatgttgtttctgacgtgtcacagaaagacagaaataactacagttgcagagcacttccttcttactctgagtttcagtctcccttacctgaaccgacgggctcccacccttagacaaaagatgacaacctatgcgtcactttccatttaggttggcttagaaactttcaagactttctttctctcttcctaggtgctgttctcacaccatcctcagcttcacttgttcttttgttttagatcagttcctcagccatgatcacatacacaaagaaatcctctatttcccttctatttacaggtgcacaaggtgggcgcccattgacagagtgagaagcaaagtttcgtttttgtttctaacttttccactgcaggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaa

SEQ ID NO: 12907 - DNA, 6466 bp, Homo sapiens
ggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgtgagtgacttcttttgttagcttcccaggaaaaccaccctccttggcctctaactctgtcctggagcagtccggttctcccttcccatttaccacgggcttcccttctttaacccctccctgtcctattaatatttcgccatccggtcacgtccacgtgctgatttggcacttgcagtcctcctggggcgtgtttcagaggcagcctggccaaggggaaactgctagagaacatctcagttgtatggcagtaatatttgttcagtgaatatttattgaccttcccttgaaggtggaaacataattaagacaaacctctacctcttgcattcttaatgagagagaaaaacatgcacgctattacgttattggtgacacgagctgagttagaaattcactctaggtagaatacattgggagaaccggagatggtgagattaattaccgttagggaaaatatctaatagcaatcagttattttcaactaacgcaaagtgtctggcactgtcactctaagccttgcagccgtttctttgcaacataggtgtcattataccgtagcacctttatataatctattaaagtaaatttcagataaatcacttgttagtgatgattttttctcctataacagttcatcgatcattgtaatagtgtctcttgtttacttgtttcttttgtcttctccgaaagaatgtaacctctgtgagaacagaaaccttgatgaggaggatgataatagtcagtgttaattaagtactttcttttctggaaaacaggtagagttgtctctcttggaggattgtgaatatcaaatggcttattagcaaaaagagctgggaggtaggaactagttgagttagtggaaaaggaaagtgagggcagagctgaggtgaagagcaattgggtttctcagagtctgagctggtaatggagacagggtgggttagaaccatattaatcatgtgaaagtatttagtgttaccattctctgcacttgttccttgcttgctaacttttgcttttgctggttaatgttttcttccttgaaatgtaatttttctgagtttattactgaaataactcttgaaatcttgtctttggtacagtgtctttcctgacactgcattacacacagacacaggtgtttttccctatattctacttccaaagaaaccctgtggtgaggagagtaacatatttgtacattttataaagttaacaatttacttactgtgtgttgacatttagtcataataaagatggcttttaagttctcctctagttctaacactgatgatacattcgtaacatcatggcatgtaaatgttctttacccagactgtacactgctcagattaaccaatgcattgggctgtgacctctaaaactgaaaatacttgggagtaaaaagaaaaaaaaaaggagctaatgaacctaagtcactaattgggtctacaagtgctctatcccatgactatggctatatatgctgtccccagtcagacttcctacagtcctacagattagtttcttctacaggggaaactagacaagttgtgaataggtggtggtagtgatggtagtagctatcatgtattgagcagttactatatgactggccccattctgttttacacaaatttactcattgaatcctcataacaatcccataaagtaaataaatacctgttttacagatgaagaatttgaggcacagggagcttatttttccagggtcatacagctggatcagtagccatgattggggtcagcaaattacagtctgtaagccagtctagcccactgtttgtttttgtatgacccaggagttacgaatgattttgacatgtttaaatgtttgtgggggcaggctgggggtagggagaaggatatttcatgacatgaaaactatgtgaaaatcaaatttcagtatctatagataaaagtttaatatacccatgcacattatttatctattacgtatggctgttttcatgctacggtggcagaagtgagtagttggcaacagagaccacatgcattgcctgcaaagcctaaaatatttaatatttggcccattatagaaaacatttgcctaccccttccatcaccactcctggtgaaatacagttgaaaatataaactttcctaataaagaaaattagtgtcagtaagtgtctttcttatgaaggacagcatagcaaatatacgtatgaggttatatcttaatcttcaggtgttaggttattatgattatgtttgttaatgaaaatttaaccttttttcttttttaaacaggttcagaaacttagtctggttgcagtaagtaagtatggactttattctgaatttatgcacatctaaactttttttttattttgacataaatgtgagacttacagagcatataaggaagccaaggtaacatgtatgtcttataaacttacattatcagcaacaaaaaagggtgccaggataaatcatgttttgcttttagttgttatgtatctttattttctttaatctggaactgttctttagactttctttgtgcttcatgacattgacacattgacatttttgaagagtacaggctcatttagaatgtccttcagtttgagtttttttgacatttcttcaggattagatttaggttgtaccccttgggaggaatcacagtgaattgtatcagaaggcacatgctgttagttggttctgttcctggtagtgattggttaggaggctctatttttaagttagtgttttgtcatttgtaacgaataagtatcttttggtagtatgcactgggactatgtaaatatcttagtactcttcaaagttattacctgctgcttttatattttatgatgatacttgcctgaatcagttattagtatgatggttgccaaatgcatgttgattatccttaatccaaaaatttgaaacccaaaatgctcctaagtctgaaactttttgagagccaacatgacgttaacagggaaatattcattggaacatttccgatttcagattttcagattaggaacattcacctggttatacatatagtccaaaatccaaaaaaatccggaatctgaaacacttctggtctcaaacatttcagataaagcatagtcagcctatagtgattttcttttgccatcattccttctactgtaaggagaagttttcccttttctcacattttggtatttctttccaatggaagggtttttttttaaactatctaatagaataaaacatttctcagggcagagaggtacttgttttaccatcaaatatggttcttgtgagagaaacagaagacctacaaggactgtaatgtgtatgtgtattaaacttatattttaataatagattagaaggcagaagaaaggcattggaacttaagttgaatacaaaagtgaatgataaacttataaaacagggttatgcaaacaaatactaatatggaatttgcagcatgaaaagtacaacaatcctgtgtctactaaccctcctgccccaaaagaggaaatgaaaaggtcagtgtgaccaggatactgagagaagaatcatatgtcacgtgagaaatgctaaagattgataggcatatttcccttggagaagactgtagaaacaatattgtctttaaatgttttaggaataggcatatagaataccatatgtaatatttttgggttggtccaaagggtagagttagagatttagattttgagttacttttaaaatttttctggagttattagtgaacttgatgttccagaagatactcacatgggttaggcatgtggctcacgcctgtaatcccagcactttggaaggccgaggtgggcagatcacctgaggtcaggagttcaagaccagcctgtctaacatggcaaaaccctgtctcttctaaaaatacaaaaattagccgggtgtggtggtgcactcctataatcccagctacttgggaggctgaggcaggagaatcagttaaacctgggaggcggatgttgcagtgtgccaagattgcatcactgcactccagcctgagtgacacagcaagactccgtctctcaaaaaaaagaaaaaaaaaaagatgttcacgtgaagactggatgactatctgtcagagctttgtgtttcaaatgacagttttttccaaataacctcaaaaagcttgttttcatttctctaggattatgtttttatttctgcaaatcctagacattctcttagggaaggacaaggtgatttcctatccttagtttgatagttactattagatatctaaaatattttagttaaaattttatacactgattctcaactttgatctttatttatatatttttttaaattatagccatgaaaaatgttatatgtatacttgaggtttctctttaacatcttaaaaatccctgtttctttcattttgtattttctgctaggtaattctgttccacaggatatctgctgtatggcagctgatggcagattagtctttgctgcttatggaaatgttttctctgcatttgcccgtaataaagaggttggtatcgctaaactacttgtttgtcagtcagtatttgtttgtcatgatagtggagggaactttaattttgtcattctttacccagcacactctggaactatacagtattcttttttttctaatgtatattcagttttctggaggaagataaattttcagaaaaggcttacttaaaactggtgctttacttcagtttctttgccagagatgaatatcaaaattacttggagaccttcttcaaaattttttatgccgttagttcccatctcaggagttttctattttgtatatttgttgagataggacataatgtgtattattaagtgtagttttaaaatactttcctagaaaattcatatttgcaccaccactttatgtggattggttatttattatgtataacttagcttataactctttttctaaaaatcagatgcctgttcgctgtttagagaaagctagattctatgttttctccactgctaaggaaagatcttttctggtctaaatctaccagttggtttctgaatttgtcctggaacaactagcttgagaagtgacctggccttaatggtctagaatgaaaggaaatgtaggaatgggggtacaaagatagccaaatgatagtatcactgtacttgtcagggacttggagtgaggtggttcccacagtctttcatcatcacttcctgtggcagaggaaggtaacttatctgtagagttctttaatggaaggtgttcagatttttagaattggaaaaaatgttcatttttgtattgttgtttatagttttcccagggagatatatgtgatttacatgaggagactttatcctatatgtataacctatatgtggttcagatgtggagactttaataaaggacctttatgcacaggtgtggtcagggttaggggaacaaaataggggtggggaggcgtcagacactgtcaactgtaggaagttgttaccacccctaaggccaaagggccaaggagaggaaacagtgttactggaatctagtgagaactgaaaccatggagaaggggctatacttatggagggatcagctactgtaaggatctctgtcaaagcagaagggtatggggaagaagaccctatatccccctttcccatctcatctgaaagccagttggtgatggagtctttagagatcagccttctggaatataccatctcgctaggatatatgtagttgcactgattgaattgggtgagggaactaggtgtgtgtgcatgcctcctctctaacccaagatggaaggcagagcctcagaggtctcatttctttgttcttaatggacagtttacttccttattgttgaactggctgagggagcagatgaacatgcctggtcccttaatatttatgtgttcatcctaaccttgaataatcaaaagttggggtacatttcttaacagaagcatctcaggattagcatgtttttgggataatatgaataatatgacatgatgactgagtaataatatgaaattcttttaaacttcgatgttttagatagtacatacctttaagggtcataaggcagaaatccatttcttgcaaccctttggagaccacattatctctgttgatactga

SEQ ID NO: 12908 - DNA, 787 bp, Homo sapiens
tacaatgaactccaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcatccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatatttctaggttttgaaacccgaat

SEQ ID NO: 12909 - DNA, 466 bp, Homo sapiens
cttgctttgtaaatgcaagcccccgggctgaatgactaatgtcttggaacttccttctgagagcaccaaaccactgccagtaatcattagagacccctcataagatctgaatagacaaagtcattcatgttaaaattaaattgggttgggcatgctggctcacacctggaatcccagcactttgggaggccaaggcaggtcaatcacctgaggtcaggagatcgagaccagcctagccaacatggtgaaacgccgtctctactaaaaatacctaaaattagccgggcatggtggcgtgcgcctgtaatccaagctactcaagaggccgaggcaggagaattacttgaacctgggaggcggaggttgcagtgagatgagatcatgccactgcactccagcctgggtgacagagcgagactctgtctcacacacacaaaaaaattaaattaaaaaaatcaaattcttg

SEQ ID NO: 12910 - DNA, 534 bp, Homo sapiens
gctggtgaggagctgcgttcctttggagtagagtagaagaggcgctctgattttagaattttcagtttttctgctctgttttttccccatctttgtggttttatctacctttggtctttgatgatggtgacatacagatggggttttggtgtggatgtcttttctgcttgttagttttccttctaacagtcaggaccctcagctgcaggtctgttggagtttgctggaggtccactcctgaccctgtttgcctgggtatcagaagcggaggctgcagaacagcggatattggcgaacagcaaatgttgctgcccgatcgttcctctggaagttttgtctcagaggagtacccggccatgtgaggtgtcagtctgcccctactgtggagtgcctcccagttaggctattcgggggtcagcacccacttgaggaggcagtctgtccattccagatctccagctgcatgctgggagaaccactactctcttcaaaactgtcagacagggacatttaagtctgcagaggtttctgctg

SEQ ID NO: 12911 - DNA, 1001 bp, Homo sapiens
tctaaacttctcttctcacttcacttcattcatttgttcttccatcactgataccctttcttccaaatgattgagtcagctactgaagcttgtgcattggtcatgtagttctcgttccatggttttcagctccatcaggtcctttaaggacttctctgcattggttattctagttagccattcatctaattttttttcaagatttttaacttctttgccatgggtgcaaacttcctcctttagctcagagtagtttgatcatctgaagccttctctcaacttgtcaaagtcgttctccatccagctttgttccattgctggtgaggagctgcattcttttggaggaggagaggtgctctgatttttagagtttccagtttttctgctctgttttttccccatgtttgtggttttatctacctttgatctttgatgatggtgacgtacagacggggttttggtgtggatgtcctttctgtttgttagttttccttctaacagtcaagaccctcatctgcaggtctattggagtttgctggaggtccactccagaccctgtttgcctgggtatcagcagcggaggctgcagaacagcagatattggtgaacagcaaatgttgctgcctgatcgttcctctggaagttttgtctcagaggagtacccggccgtgtgaggtgtcagtctacccctactagggagggcctcccagttaggctactcagggttcagggacccacttgaggagacagtctgtccattctcagatctcaagctgtgtgtgggagaaccactgctctcttcaaaactgtcagacagggacatttaagtctgcagaggtttctgctgccttttgtttggctatgccctgcccccagaggtggagtctacagaggcaggcaggcctcctttagctgcggtgagctccacccagttcgagcttcccagccgctttatttacctactcaagcctcggcaatggcaggcacccctcccccagcct

SEQ ID NO: 12912 - DNA, 350 bp, Homo sapiens
aaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgct

SEQ ID NO: 12913 - DNA, 432 bp, Homo sapiens
aattcagcagaaggtctttaatctagttagtgtaactgagattttgccatataaatgattttttcttcatcccatttggatttcaaagccactgataaacctttttttggagtgatcctaatggaattaatcaaatttaaggagatgttgacttaaaatctttattagtggaaagaaaagaatattaataaaaggctaaaccactgcatcttgcatccctaaaaggattattttaaattcaatttttgcactgttattattaaagcagttcactcaaccagtcactaggtttgaactttgatttgaatcgaggtttgcagggcttccatcaaatctctgctaaatccagcttcggagaggagcagttaagtgtaactgcagccaaggttagaaaccttggctcacaacacttggccttgaccagcaggtacc

SEQ ID NO: 12914 - DNA, 301 bp, Homo sapiens
ctctttttgatggggttgtttttttcttgtaaatttgtttaagttccttgtagattctggatattagccctttgtcagatagatagattgcggaaattttctcccattctgtaggttgcctgttcactgtgatgatagtttcttttgctgtgcagaagctccttagtttaattagatctcatttgtcaattttggcttttgttgccattgcttttggtgtcttagtcatgaagtctttgcccatgcctatgtcctgaatggtattgcctgggttttcttctagggtttttgtggttttagg

SEQ ID NO: 12915 - DNA, 672 bp, Homo sapiens
ataatagacaaacagagcaccaaatcatgagtaaactcccattcacaattgcttcaaagagaataaaatacctaggaatccaacttacaagggatgtgaagaacctcttcatagagaactacaaaccactgctcaagtaaataagaaaggacacaaacaaatggaaaaacattccatgctcatggataagaagaatcaatactgtgaaaatggccacactgctcaaagtaatttatagattcaatgctatccccatcaagctaccattgactttcttcacagaattagaaaaaactactttaatttatatggaaccaaaaaagagcccatatagccaagacaaccctaaacaaaaagaacaaagctggaggcatcatgctacctgacttcaaactatactacaaagctacaggaaccaaaacagcatggtactggcaccaaaacagatatatagaccaatggaagagaacagaggccccagaaataacaccacacatctacaaccatctgatctttgagcaacctgacaaaaataagcaatggggaaaggattccctatttaataaatggtgctgggaaaactggctagccatatgcagaaaactgaaactggatcccttccttacaccttatacaaaaattaacttaagatggattaaagaccgtcagctt

SEQ ID NO: 12916 - DNA, 452 bp, Homo sapiens
ctttcatacaaacacaataataatatgatataatgagtggttgttgagagaaattcttaacataaacctttgtcaaatacagttgctatagccaaagaaagaaatagttctatgtattgtaaatctctatttgaaatactatgccaaataaatgatgcaactcataatcgcacattagggctggttgcagtggctcatgcctgtaatctcatcactttgggaggccgaggcaggtggatcacgaggccaggagttcgagaccagcctagtcaacatggtgaaactccgactctaaactacaaaattagccaggcattgtggcaaacacctgttttccctgctactcaggaggctgaggcaggagaattgcttgaaaccagaaggtggaggttgtggttagctgagattgtgccaccacactccagcctgggcgaaagagtgaaactccatct

SEQ ID NO: 12917 - DNA, 219 bp, Homo sapiens
actcacaagagtgaaagaataattcaaaaatctaaatgtgggaaggaagagggtgagaagggagaaaaaaatagagaagtcaacaagagccttggcagggggtgaagtccgcagtgaaaatcccatggtgccaaaatggccaaaggatgctttaaagacaaaaatgttctaatgtttaatttcaaatggtttgtttttccatgatgcaaacccattctt

SEQ ID NO: 12918 - DNA, 720 bp, Homo sapiens
gaaatttgcagttatatttttattaaaataaaaccctcatcctaatcctgaaaggagaaactgtgtagtagcatacaaagaacattaactttctaatcctgaccttactgtttcttggttatgtaactttaggcagcttacttacttttttctgtgcctcagtttctatacttgaaaaatggtgacactgctaggtacacacacacacacacacacacacaaaatacaattaaaaagtgggtgaaattcacaatagcaaagacatggaatcaacccaaatgcccatcaatgatagtctggataaagaaagtgtggtacatatacaacatggaatactatgcagccataaaaaggaacgagatcatgtccttttcaggggcatgggtggagttagaagccattatcctcagcaaactaatgcaggaacagaaaatcaaacaccacatgttctcacttataagtggcagctgaacaatgagaacacatggacacagggagggcaacaacacacactgggacctgtcagagggggtagggggaaggagagtatcagaataaatagctaatgcatgctggacttaataggtaggtgatgggtggttaggtgcagcaaaccaccatggcaaatgtttacctatgtaacaaacctgcatgtcctgcacatgtatcccagaaagtaaaattaaattaaattaatttttgttttttaaaaagtgagtg

SEQ ID NO: 12919 - DNA, 133 bp, Homo sapiens
cccaccaccatgcccagctaatttttgtatttttagtagagatggggtttcaccatgttggccaggctggtctcaaactcctgacctcaagtgatccacctgccttggcctcccaaagtgctgggattacagg

SEQ ID NO: 12920 - DNA, 246 bp, Homo sapiens
cctggaattcaccttgaattgatttctattggagacagttatccaatctaatttgcctcatatggataaccacttgttctattactgctgtaacaaatttctacaaactaagtgacctaaaataacacaaacttatcatcttacagtgtacacaagtcagaaatcaggcatgcattttagtgaactaaaatcaagttgtcgacaggcatgtttctttatggcggctagggtagaatccatatcctg

SEQ ID NO: 12921 - DNA, 554 bp, Homo sapiens
gctctaactattgaaacaagcttgaatttctggaataagcccaatgtgatatgtattcaacaaatattcattgagtatacctagtatgtaacatgctttaagaatacaccagtgaaccaaacagaaatatctgacattacagaacttaacattccagtatttggagacagatgataaaaaagtgaacatgtatatttacagtttgtcaaggaatgataaatgaggactcttaaagtagatggggaattgggagtgaagtctgtaatttaaatagtgtggacaggaaagcttcgcagagaatgggacatttaagaatagacttgaaggacaggcaagagcaatctctatgtttatatgggagaaaaggttccaggcagatgcagtaacaatggcaaatatcctgaagtaagatcatgctggagtttttgtgcagtagcaaggaggctagtgtgactgccacagaatcacccaagggaagatgagaagatcagaccagaccagcacttgggcatctaatgggaaaagtttctcaagccatcataaaaatttcactt

SEQ ID NO: 12922 - DNA, 324 bp, Homo sapiens
agaattttcagcttttcttctctggtttatccccatctttgtggttttatctacctttggtctttgatgttggtgatctacagatagggttttggtgtagatgtcctttttgttgatggtgatgctattcctttctgtttgttagttttccttctaacagtcaggtccctcagctccaggtctgttggagtttcctggaggtctactccagaccctgtttgcctgggtatcaccagcggaggctgcagaatagcaaatattacagaacagcaaatactgctgcctgatccttcctctggaagctttgtcccagaggggcacctg

SEQ ID NO: 12923 - DNA, 927 bp, Homo sapiens
cactgcacccactgtcctccacccactgtctggcactccctagtgagatgaacccagtacctcagatggaaatgcagaaatcacccatcttctgtgtcactcaccctgggagctgtagaccagagctgctcctattcggccatcttggctccaccgtatccttgttttaatagaagaaaactgtataatatcaatattggaatggttaaatactgttttacttattatattgatattatacattcattagaagatgacttaattagccaggtgtggtggtgcatgattgtagtctcagctactcgggaggctgaggtgggaagatggcttgaggcaaggagttcaagaccagtctggacaacatagcaagaccccatccataaaaaaattcccagactgacaaagaaacttaaaaaataaaacatagactaagatctcattaacaaattaacattgtatatatataaaacagctgtgaaataaactaccaaaaagattctcttctacatcatatgtcaccagggaaatgtgagttaaaacaacgagataccactacctaccaattagagtggtcaaaatccagaacatgctgtggaaaatgtagagcaccaagaaattttatccattgctcatggggatgtaaaatggtacagccacttaccaaactaagcatactttgaccatactctccagcgatcacactccttggtgtttaccctaataaactgaaaatttatgtccacacaaaaactggcacataaacatttatagcagctttattcatacttgccaaaacatagaacaaccaagatgtccttcagtaggtgaatggataaacttggtacatcaggacagtgaaatattattcagtgctttaaaaagaaagaaagaagccatcaagccatgaaaacatctagaggaaactta

SEQ ID NO: 12924 - DNA, 434 bp, Homo sapiens
tcacagatatggagcatctttaatgaaggggttggggaattaaaagcaaggggaaaagtattcatgtcttttctgggaattaggtagataacttctcagaaccagagtttttgtcccccttttttgtccttttatggtttcttctggtcgttgtcatggtgattgtcagctgtcttggcactggggggagggtcatttagcatggaaattagattataatgaagttagaggttcttcagaggtcaagtgagctgccatcttggttcccaccactcttagctggtttggtgtcatgatggggagcttttgaccacagacatcccgtttcctaaagataaccagagttaaggtggggaagaaatttacttaggtcacacagacgttacactgggtaacaacattactttgacaacaaaaataaatgcactttataa

SEQ ID NO: 12925 - DNA, 149 bp, Homo sapiens
gctgcacccactgtcctgcccccactgtctggcactccctagtgagatgaacccggtacctcagatggaaatgcagaaaacacctgtcttctgcatcactcactctgggagctgtagaccggagctgttcctattcggccatcttggct

SEQ ID NO: 12926 - DNA, 521 bp, Homo sapiens
aatcagcaaaacaaacccaaacaatcacatcaaaaagtgggttaaggatgtgaaaagacaattctcaaaagaagatatacaaatggccaacaagcatatggaaaaatgctcaacatcactatggaaacgcaaatcaaaaccacagtgcaataccacctcactcctgcaagaatggccataatcaaaaaattaaaaaataatagatgttggcatggatgcagtgaaaagggaacttttacactgttggtgggaatgtaagcttgtacaaccagtatggaaaacagtgtggcaattccttaaagaactaaaagtacatctaccatttgttccagcaatcccactactaggaatctaccaagaggaaaagaagtcattatgtaaaaaagatacttgcacacacgtttatagcaccacaatttgcgattgcaaaaacatggaaccaaaccaaattcccattaatcagcgagtagataaagaaaatgtggcgtgtatacacacacacacacacacacacacacaca

SEQ ID NO: 12927 - DNA, 331 bp, Homo sapiens
agaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtat

SEQ ID NO: 12928 - DNA, 276 bp, Homo sapiens
cgccaggtgtggtggctcacgcctgtaatcccagcactttgggaggcggaggcgggtggatcacgaggtcaggagatcgagaccatcctggctaacatggtgaaaccctgtctctattaaaaatacaaaaaattagctgggcgtggtggtgggcgcctgtagtcccagctgctcaggaggctgaggcaggagaatggcatgaacctgggaggtggagcttgcagtgagctgagatcgtgcctctgcactccagcctgggtgacagagtgagactct

SEQ ID NO: 12929 - DNA, 98 bp, Homo sapiens
gctcttggaaacacccagaggacactggaaacatagccacagggacatagaaccaagccccaggcctgctcagctacaggaccgccgctgggatccgc

SEQ ID NO: 12930 - DNA, 250 bp, Homo sapiens
taaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcagga

SEQ ID NO: 12931 - DNA, 129 bp, Homo sapiens
aaggcaaagtgctgagcgaagggggaagacccccttataaaaccatcagatctcgtgagaactcactatcatgagaacggcatgggggaaaccacccccgtgattcagttacctccacctggctcctcc

SEQ ID NO: 12932 - DNA, 155 bp, Homo sapiens
ggcgtagtggcacatgcctgtaatcccagctactcaggaggctgaggcaggagaatcacttgaacccaggaggcagaggttgcagtgagccaagattgtgccattgcactccagcctgggctacagagcaagactctgcctcaaaaaaaaaaaaa

SEQ ID NO: 12933 - DNA, 524 bp, Homo sapiens
tattttgtttaatttttggtctccacattagaatgtaagttccatgaggacaaggatttgggtctgttttgttcttggctgtatcctcattgcctagggaagtgcctagcacttagtaagtcctcagtaaatatatgaatgacttaatgaacaaatgaatctttccctgcagggcagctctacattctgtattttggtataaaaattggcttagttagaaatggctactcacacacaactcaccccttggctcaagccccacgtctgtactctgcaaaaggcctgcagccactgaatggttgggcacgaaggcaggtttccaaacttaatagagtggtgccctttttgaaggaaacaagacatcaaaagcctctgtagtacactcggagtcctcatgttgagaaactttagctaatgttgtatatttaccctaagaccatcttccatttgacaccaaaaaaagaggtaactggtaagcatttttaaagattatcactaaaataaaagtaaatttaaaaatcttt

SEQ ID NO: 12934 - DNA, 226 bp, Homo sapiens
gacagagttttgctcttgctgcccaggctggagtacaatggtgtgatctcggctcactgcaacctctgcctcccaggttcaagcaattctcctgcctcagcctcctgagtagctgggattacaggcatgtgccaccatgctcggctaattttgtatttttagtagagacggggtttctccatgttggtcaggctggtctcgaactcccaacctcaggtgatccgcc

SEQ ID NO: 12935 - DNA, 452 bp, Homo sapiens
ataaatgtcttctttcgagaagtgtctgttcatatcctttgcccactttttgatgggattatttttttcttgtaaatttgtttaagttatttgtagattctggatattagccctttgtcagatggatagattgcaaaaattttctcccattctgtaggttgtctgttcactctgatgatagtttcttttgctgtgcagaaactctttagtttaattaggtcccatttggcaattttggcttttgttgccattgcttttagtgctttagtcatgaaggctttgccatgcctatgtcctgaatggtattgcctaagtattccagggtttttatggttttagatcttatgtttaagtctttaatccatactgagttaatttttgtataaggtgtaaggaaggggtccagtttctgttttctgcatatggctagccagttttcccagcaccattta

SEQ ID NO: 12936 - DNA, 601 bp, Homo sapiens
tttgatgatggtgacgtacagatgggattttggtgtggatgtcctttctgtttgttagttttccttctaacagtcaggaccctcagctgcaggtctgttggagtttgctggaggtccactccagaccctgtttgcctggatatcaccagtggaggctgcagaacagcaaatattgcagaactgcaaatattgctgcctgatccttcctttggaagcttcgtctcagaggggcacccagccatatgaggtgtcagtcggcccctacggggaagtgcctcccagttaggctactcgggggtcagggacccacttgaggaggcagtctgtccgttctcagatctcaaactccatgctgggagaaccactactctcttcaaagctgtcagacagggacgtttaagtctgcagaagtttctgctgccttttgttcagctatgccctgcctccagagatggagtctacagaggcaggcaggcctccttgagctgcagtgggctccacccagttcgagcttcccagccactttgtttacctactcaagcctcagcaatggtggatgcccctcccctagcctcgcttctgccttgcagttcaatctcag

SEQ ID NO: 12937 - DNA, 26496 bp, Homo sapiens
actgccgggctcggcgtgagtcgctgcggggctgacggggtggcagtgcggcgggttacggcctggtcaggtgagcgggcgttgcggttctcgctgcccggagcagcgtaggagatccttggggtggccggtgggaggaggggtagcggttatgggtaccggtgaggcggggcgggccggggctggcggtggaggcgcgcgttgaggcggcgcgtcggtgtccagggcagcggcgtctcgggtcgcgcgttcccggaggggctcgcccccgcaacccgggcctgcgcgctctgctttgcaggcggaccctccaccctgctgcgattttgcagtgctcgggaaggcagagccgccctcccgcaaagaccgaggtggggcccgcccccttgcggcgtgggtgtgcggtgttcgccgggacagcgggtgtgaaagtgatacccccagcgctggaagtttttgattgctggctcgcacccccgccccatcgcagggtccctgggagagtttttgggcctgctcgagcagcagcggtgatgggtgaaatggaaaagcatctaacccccgtcagcatctcactgacttgttgcgcttttattcatttatttgagttcccaacaaagcgttgtactagttttgtttttgaatgagttgtgcatatatggtcaaacatggacactgcctgaaagaagcttaaacctaatttagttgttgaggctacgagtcagaagacctatctgcatctgcaactgtcccttcttagtgaggtatttttcactgtcctaaacaaatgtttttctaattccgtctctctccctcccaccttacttctcttccctccgcctaaagctttgactcttctcctacctttttggagattttgccccatcactcatcctttttcctgtatcttttactttgttgctttttccccagactatgctcaagaacaagtcttatattatcaaaggcaaatgtactgtaatctccatataatctcatttacgtaactcatttcattcccccccctcctttttttttggtcccaggctggagtgtagtgggcccgtcaccgcccactgtggcctcgatctcccgatcctcccacctcagcctcctgagtagctggaactataggcaccctccaccacgcctggctaatttttgtgtttttagtagagatggggatctcgaagtgttgcccaggctgatctaggaactcctgagcccaagctattccccctgccccccaacctctgcctcccaaagtgccgggattacaggcatgagccacctgcggttggccttccaccctttaaaaaaaatcttattgaaactctaaatagaggtcaggcgcggtggctcatgcctataatcccagcactttgggaggccgaggtgggcggatcacttgaggtcaggagttcgagaccagcctggccaacgtggtgaaaccccgtctctactaaaaaaaaaaaaaatacaaaaattagccgggcgtggtggcctgcacctgtaatcccagctgctcgggaggctgaggcaggagaatcacttgaacctaggaggtggaggttgcagtgagctgagtttgcgccactgcactccagcctgggcgacagagcaagactctgtctcaagaaaaaaaacaaaaactctgaatagtctttttatgactaaatataatgcactttctttccctctgtggcatttggcactgctaacctctcactttcttcaactcattttttgtcatctgtaacagtacactctaggtttttctcccaactgtctaggtgctactgcctacttttttcttccttggcatctctttctccgtttagtgttctccaggttcaccccattccccagttgtcacaatggttaaacatggccacatccttgattctagcttctacctttctgctagtgacaccggaatttatctctattcctacatagctacctatggggtatctcttcgccccattagcactcaaattcagcatatcccaaacaaataatctgactttccgtttgccctccaactttgatgcctcttttccttttaacattgtatttcttgactcaaaatggcatcagtaatcttaccggggtcccaagccagaaatctaggccactgtttgagtctttctctgttctccaacacctcagtctagtcagtcatcaagttctttttattttactaccttgatattttcacataactttcagaatataggttagacctcatggcctgccatttcaagtctgtcccatgtccacctctttaattttcttttccttcattctccctcataattcctcactctgcctgcccactcctccctgttagtcacttggcgggcccctttgaaatccagctaaagttccaacacctctggggactccttccgtgacaccaccaccctactatctgatccatgcctattttttgcagtcagttccatagcatctgtatgtacctctgacgcagggttctcaaccaggggttattttacctctcagggaacatttggcagtgtctgggattcttcgttgtcacaatccatgagaggaagggataatcctggcacctagttggtagaggacagaaatgttgccaaccctcctacaatgcacaggacagcactcttaaaataaattttttggcccaaaatgtcagtagtcccaaggttgagaaaccctgcttaacatattttgttactagtgctttatatatttttttcttctccactgcacaagggaccttgtcttgtttttgcatccctaaatcttgattcagggcctttcacatagtagaagttaaatgttggaagaaaaagaaataaaggaggtaatcgctcaactccagagatgagcagcctgtctgctaccacaggctacctgataatttcagtgatttttctccccattacctttctttaatgttgcctttcaaggatgcttcaacttgtctatttttcatttgtttattcagcaactgatttatttttaaaatattatattgatttttctttattcagcatcagttggctgtcttctgtccatgtatcttggccacttatgaagtggtaaaagataattagctagctttcagaaaaataaaccaaataggcctattcttatcagaggttggttgttcaaaactctgcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagaggtaaattaagaattcgtaattaagatccaccaaaactaattttataaaaataaagcataacttttaaaaatgttttgtgaaaatactgaaattgaagtgacttgcttcactgtcaattttcttttctttttttttgtgatggagtcttgctctgtcaccaggctggagtgcagtggcgcgatctcggctcactgcaacctccgcctcctgggttcaagcagttctcctgccttagcctcctgagtaactgggactacaggcgtgcaccaccacgcccagctactttttgtatttttttttttttagtagagacggggtctcatcatgttggccaggatggtcttgatctgttgacctcaagtgatccacccacctcggcctcccgaagtgctgggattacaggcatgagccaccgtgcccggcccactgtcagtgtttttagaaattctgcttttcaaaaagtctttgtaataattaaatatattaccatattttaaggcttagtgagtagttactgaagggatgatcatgtgataatacttagaggtaaataaatgactagcatcataaaatatgtagaggtgtgtgtgtataaaaataatatgtgtagttatatactaatgatatattaacataccatattggcataaaaatgcagatagtacctaggttcaaccaaaagtttttcttaagactgcatttaaatatggctgggtttttcatactgtacataatatggaggcagttcagtttgtctttgcactactgctggttcatcgtactaaggctgaagataggtcgtttttgaagtttgaatttaggattgcaaattaaaggtataattagaatttctaggtaatacttttttcttgtgattgaacaatgttcaacactcatcaaagtatgaattaaacttttaaagtataattgttataagtgaaggtggtaaattggtctttttaaacactttaaaattaaaaaattcttagaagaaaatatagtgagaattttaaacatagctagttatacaaagagtaacagagcataatactcacaactttgtgtttttttttccctccttagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggtaagttaatctagtcatttgcttcttaatatttgagtaaaattttctgggagttagctgataatcatgggttaagtgaaaaataatgtagagttatggcctgtgtttttctcttattcatgattttatgtggaataaacatttaatgacatagctctttagttaatgagataatttttttttctgcaatcctctttcagcaaatggtggctaaaacagccaggattttattcttttttctttctttttacaaaaattactgtttacttattactatttatttatccagtgtgctcttcatccagtttcctctggtggttacatctttcttagctgtagtatacagtatcaaaactaggaaattgacattggtacagtgtgtgtatggttctgtgttattttatcccatgtgtaggtttggataacccagccgcaattaagatacagatatatggcaccaccacaaagattccctttgtgccatccctttatagtcatactgctcctctctacgccaccttctctaacccctaaacagtcagaattctaagatactcccagaaaagaatgactgtgcagatgtctttgtcataaactgaaggacctgtagaaatgtgctaaaagagaatgcctttgtgtctagtcttaggactggggctgtgtgacgataaacataggcctatcttgatcctaggaagttgggcttctttacccttctagactgggatagcagatatgtgtcctcccatctcccacatgtgatacacaacatacttggagaatcaccatcagtgctctgccttacaaccctttaccagtgtttcaagcagccactgtcgtgtcagcctgtgaaagagaacctgttggccagccctattctgcactgtgatctactttaagggttgatgtggttaggggtatgtatgttgggggatgtgataaccaactgatgaatttggaatatatattcctctttagtttttaaacaagtgtttattacgtaatatttgattcataccaaagaatatgtagagatgtatgttctaaagcatagtaataaaatgaatacatgagcctaccatctaacttaaagagaatttttccaatattattgaagctactggtatgctcctttctaatcccatgttcttttctcccctctactcccagaggtaaccactgtctgatttctctgtttattattttctttgcatttttctgtttaacatttttactgaggtataatgtgcatcaagtccaaaaatcttaagtgtgcatcttcctgaatttttactcaagtgtacacctgtgaaaccactgtttggatcaagatacagaacattctgggaggctgaggcacgagaatggcttgaacccgggaggcggaggttgcagtgagccaagatcacaccactgcactgcagcctgggccacagagggagactctgtctcaaaaaaaaaaaaaaaaaaaagaacatttccagcctcgcagaggccttcctttcagtagatgacctctgaaaagtagccactgttctgacctcttacactgtagatagttttggaatttcatataaatgattataccgtatgcattatttaagtttggcttcttttgctgtcattatatgagatccatattgtgagtagcagcagttctttttcattgctgaccagaattccattgtgtggatgtctcaatttttgtgtccattctcttattgataatacttttgtattgttggcggtttggggctatgatgaataaacctgctgtgaacattcttgtatttgtcttttggtggatataagcaccctagaggggatttgctgggtcatagtttataaatacatgtagttttagaaaatactgtcaaacagttttccaaattatttgtgtggtatttttcttaataaaactaaggctaattaaaagagcgctgggacttttatttagtttgccatctgcttcaggattgtcccaatataagagaggtaaaattttgagtcttgaatttatcactgttggaactactttctgaaaatagaatttattctcaagttcacgtagcctgtcttcattttttgtgtgtgtgactttttgttatatagcctgttccttttcatcagttggtgtcttcttataatgccctttcctgaaaggcatcatctcagatgatttcttacagagatgttttctacactggcatttactcattcaacagatattgattgagctcctgctgtatgtggacaatgccatcaagattgtactgcatagcttgcagttgtcattttggtgtctgtatacaagatatggttgtttaattcccatttcattctagttcagatctgagcagctgctttagtgttctgctgctgttagttttctatacatgtcagcatagcagggttggataatcctggcagcaatgttggtaggctggtggtatttctagaatcttcatgctaaaacacatagctaaattttagtccatgtttcaatgttcatttaatgaaactatgcataatttttttatttttataagcaatttttttcctacgtaaataactttagtgtttgaatgcaaaaagaattttgtttacataataattaaagtttgtatttaaatgtgctttaatgaactctaatggtcgtcacggtggcttacgcctgtaatcccaacactttgggaggctgaggcgggcagattgcttgggcttaggatccagaccagcctgggcaacatggcaaaagcccgtctctacaaaaaataaaaaaattagctgcgcatggtggtgcatgcctatagtcccagttacttgggagagcgaggtgggaagatggctggagcccgggagatggaggttgcagtaagctgacatcacactactgcactccagcctaggcaacagagccagatgctgtctcaaaaataaaataaaaataaaatcttactaaaaatcattgttttatcatataaaaaataagaggaaaattctggtggaggtctatgaaattatttattaccatgaaagtagtgtgagtcaaaagagattgagaatcgtgggactagcacattttttatttttcctttagtagaggcagctatatgttggaatacaccgagagacagtataacatatcgattgagggctcttggaggaagtagacttggtcacttactagctgagtgaccttgaatgagttaactaacttctgcatttcagttccctcaagtgaaaaacatgggtaattataccttcctcataggttattgtgaagattaggagttaatgtgctcttttttttgttcgttttaaaatagcagttttaaaatagcagttttttgttttaaaataaggaagaaaaaaatttttttttaaactttttctgctactgggtgctaattatattagtttagggctatttgcaaacttcctttaagccataagacctaactgctaatagttcgtgatttaggggtgatttgtacaatctgttgacttagctttatgagttcaaagtcagatttttggttttgatcttggttttctaagctaaggcatctttttctctggatataatcttaacaatgagagatttgggttgctttgtaaggctgtaggtccttagattgtaacaatttacattcatttgagtgtatttttttagtatgtctttttttcttttttttcctaatcatataattatgacccctgttttccgtcttttgattttaggaccgtatccttgatgagcttgacaaagacgatagtacccatgagtctctgtctcaagaatcagagtcggaagaagatgggattcatgtagattcacaaaaggctcttgttttaaaagaaaaggtactaattagttaggttttgttttttttcatgtaagcaggagatgttgaaaatcatgtggatcgtaaagtttcttgagcatagttttagtacgtgtttaaactttatgttgtttttggctacatccctctctggaggcattgtaacatggtggttaggagtacatgctctggagccagattacctgggttcaaatctctgataagttctttaaacttctgaacttcagttttctcatctgcaaaatgataatattaccaacctcaacgggttcttatgggtagtaagtgaactattctatgtaaaatgcttggactgtacctggagttgtccagtgtttttagtagtagattgaagtaacttgaaattagtgtgtgattcttggcgtaaatattatattccactcccgggtatcaaaggctatctttggttactttttggaatgttcagtatctccctgagggatgcctcattattataaaaccagctatattactttcacaaaggtggaactcttttcagattaaactcttgatgcttttttttggttacatttctgtaggttggcattgtcaataaggagtataatgctgggtattttactcatttttctgcctgggctcttgggttgtacccatacagtgaccatgtacagttacccttgaacagtgtggggtcagtgcctcatgcagtaaaaaatctgcatataacttttgactccccaaaaacttaactactaatagcttactgttgaccggaagcagtatggataatacaaatagttgattagcacaaattttatgcgttatatgtattatatactgtattcttacaaaaaagtaagctagagaaaagaaaatgttattagaacattttaaggaagagaatgtgtatttatttatataaatatatttcactgtgtagaagtggatctaaagtcttcatctttgtcatcttcatattgagtaggctgaggagggggaaggggaggagttggtcttgctctctcgggtggcagaggcagaagaggtggaaaaggtggaaggggaggcaggcacacttggtgtagacttctattgaaaaaaatctacatttaagtggacccatgcacttcaaacctgggtcgttcaagggtcaactgtagtgaatttcagaatttgtaaaaaagatcattttatataattttctttcagggcaataaatacttcaaacaaggaaaatatgatgaagcaattgactgctacacaaaaggcatggatgccgatccatataatcccgtgttgccaacgaacagagcgtcagcatattttagactgaaaaagtaaggactttctgtgacgtgtgtgaatgtgaatgtcttatgtatatatggagacttattaaaaaaaagtgtggaataaagtgtggaggacagattgaaaatgtattgcattttcttttcaactgtaaattcttatagctcactcctttttattgaattattttgtttaagccattttaaacatctggtgctaaaaccttgttcccatagctcactttactgaggtattcctctaaagatttagtaatagtgttcttttctaattcacaaagctaaaaaagttagttggatatttttagaaattaatatcctgtcattttgaaaaaccatttatccactatttaatctagagaacatttattatggaaaacttaaaatatgtttcaacatttgtttgtctttaagtcatactgacttttaaagtaaataatgtggaagaatataaatgtggtattgtcttatcacatgcaggtaaccaacctatcataggggttttttaaaaagataaacaccatcaaggaagacattcttactgttttaattatttggaaatacaaattttattggtatctgaatttttactatttaacatttttatgtctttgaaactcatgatattaatctctaaaaattaggggaatatttacattttataatattcgatatctgcaatatatgtagcatatacataaattacagagaatagtttaaaataagcctataaagcacccctctcaacttaagaaccagaacattaccattatttttgaagttaccttgatgctcctttctgtatcctgtcccttgcctccctcccagttaaccactatcttgaattatatatttgtcatccttttgatttaaaaaaggtttattatatatgtatatgttcctaaataatatatagtataatcttgcttatttttgagcttaaaagtatatcatactgtgtgtagttttctgtggctcacctatttattatatttttatgattcattcttgttttgatgcttatagctctagagctctcattgtaactgttatataggataatttctttttagaaatataccattatgtgtctattcttgtgttgctggattgttggttcgttcctttcttcctttctttttctctctccctcccactctttcttccctccttctgtccctctttctttctattgcccaccttctgtcctttctttccttatttcagcaatgctatgaacatttttgtacatgtttcttggtgttgggtcataaaatgtgtagatgttcagcttcacaggatgatggcaaaggtagtttgttgttacacagttgttacaaaggtaaatggatgagtttacattctcattagcagtgtataataatacctatttcctacccttaccaacattgatataattgggcttcttaattgttttcaatctggtgggtgtaaaatggcatttcattgtgtctttgaaatgacattttgcatttctcagctattagtaaggttttcatttctcaactattagtaaggttaagcatcttatatattttccatttttgtttttttcttttttttccctgtgaaatgcctatttggtgtttggccatttttttttttagggcttttcctattgatttattttgagagttctttattctggataactaatcttttggtcttttccataataactatcttctctcaatttgtagcttatcttctttatggaattttaatgaatagaaacattcaattttaatatatttcaacttcttgattttttaaaaagattaggactttataaaatgatttgttcaaaaaaatagtttgctgcttgagttcctaatagtctcctctaatttcttctaaacatttttaagatttacttttcacatttaggtgttttcacatatgctgaaggtttttccagctctatttttggaatagccctactttcccccgtggatctgccgtgctactattgtcatatgtcatgtttgccgagatcactttctcatctctgttctttacactggtctgttgcctgtccttacatccattccacactatctttaattattatagcattgtaattgtaagtcttaatatttagtgtactgcatattctcctaccttttattattcaggaatgtcttgggtattcttggacttttactcatcaatataacttttagaatcatcttcccaaattcgttaaaatatcctgttgggattttgattagaattgcattagatttataaatcagtctggagagaatcatattgtatgtttttgtactttattatagatgaatgtgaaatatctccacttagattgtcattaatgtctttgaaaacagtcttacaattttttgcatctgtgtttggtaggtctttgttagatgttttgtttgtttgtctcttgttggtctctcgtagtcaccttactaaacttgtaatacttccagcaatgtctctagattgttttgagttttctttttggaccatcttatcatttgagaataatttcaggcctttttctttgtttctagtccttgtgtttctttcttgtggaactgcattggtaaagacctgtatgtaataccaagaaaaagcagtgataatgggcattcttgtttctctcattaaagggaatgctactaatgtttcaccattaggaattataggcataccttgttttgttgtgtgtcgctttattgcgtccacagatactgtttttacaaaacgaaagtttgtggcaaccttatatcaggcaagtcaagcaactctattggtgccatttgtccaacagcatgtgtttactttgtgtctctatgtcacgttttggtaattgttgcagtatttcagatttattataattgtatctgttatggtgatctctgatcagggatctttgatgtttctattgtaattgttttggggagccatcaagcacacccatatgttgttgtgcattctgtctgcttcattgaccagctacccccgaccccccatctctctccttctccttgggcttccctattccctgagacacaacagtattgaaattaggccagttaataaccgtacagtgaggccaggcatggtggctcacacctgtaatcccagcaatttgggaggctgaggcgggcggatcacttgaggtcaggagttggagaccagcctggccaacatggtgaaaccctgtctctactaaaaatacaaacaattagccaggtgtggtggcgcatgcctataatcccagctacttgggagggtgaggcaggaaaatcacttgagcccaggaggcagaggttgcagtgagttgagatcatgccgctgcactccagccggggcgagagagtgacgctctgtctcaaagcaaacaaacaaacaaacaaaaccctacagtggcatataagtattcaagtgaaaggaagacttgcagatctcttactttaaattggaagctggaaatgattaaacttagtgaggacggcatgtcgaaagccaagactgactgaaagctaggcctcttgtgccagttagccaagatgtgaatgcaaaggaaaagttcttgaggaaattaaaagggctactccaatgaacacaaataattaaaagcaaaagaagcttattgttgatggggagaaggttttattggtctgtatagaagatcaaaccagccacaacattcccctgagccaaagtctaatccagtgcaaggctctaatgctcttcaatttagtgaaggttgagagaggtgagaaagctgcagaagaaaagttgaaagctagcagaagttggttcatgaggtttaaggaaagaagctgtctccataacataaaagtggaaggtgaagcagcaggtgctgacggagaacctgcagaaagttatccagaagatctagctaaggtaattgatgaaggttactgtgttaaacaacacacacattttcagtgttgactaaacagccttctgttagaagacagtgccatctagggcgttcacagctagagagaatgcctggcttcaaaggacagtctgattctctctcttgttaggggctaatgcagctggtgactttaagttgaagatagtgttcatttaccattccaaaagtcctagggcccttaggaattatgctaaatctactctgcctgtgctctataagtaaaacaacaaagtctggatgacatctatttatgaactggtttactgaacattttaagccaactgttgagacctactgcttagaaaaaaagatttgtgggaggccgaggcgggcagatcacaaggtcaggagatcgagaccatcctggcaaacacggtgaaaccctgtctctactaaaaatacaaaaaattagccaggcgtggtggcgggcacctgtagtcccagctacttgggaggctgaggcaggagaatggcgtgaacccgggaggcagaggttgcagtgagccagatcgtgccactgcactccagcctgggcgacagagcaagactctgtctcaaaaaaaaagaaaaaaaaaaggatttatttcaaagtagtgtactgacagcgcacctactcacccaagatctctgatggagatgtacaaggacatgaatgttgttttcatgcctcctaacacaatatccattctgcagcccatggatcaaagagtcattttcaatttcaattcttgttatttaagaaatacatttcacaggctatagctgtcatagatcgtgattcctctagtggatctggacaaagtagattgaaacctggaaaggattaactattttagatgccattaagaatgtccataattcatgggaggaggtcaaaatatcagtgttaacaggagtttggaagaagttgatttcaactcttatggatgactttgaggggttcaagattttagcggaggaagatgtcaccgaattgctgcaatcttgtattcaaacttgaatggatggtcagttgattcttatggatgagcaaagaaagtggtttcttgagatagaatttattcttggtgaaggtgccgtgaacgtttttgaaatgacaactgaagatttagaacattatataaacttagttgataaagtggcagagtttgagaggattgactccaatattgaaagaagttctgttatgtaaatactatcaaatagcatcacatgctaccaccaccaccgtgatcggtcagcagccatcaacatcaaggcaagatcgtccaacagcacaaagataaatattcactaaagactcagattttattagcattttttagcaataaagttttttaattaaggtatatacattgttatttagacataaagcttttgcacacttattagattacagtataaataaaacttttgtatgcactggaaaaccaaaaaatttgtgtgactagctttattgtgacatttactttcttgtggtggtctagaatcaaacccacaatatctttgagcaatggcagtattgcttttattatgcttaattaactgaaagcaggtgggaaaaatgccttcagtgggtaagtaaattctcttttcaaggatttcagaaacaaattttgaagttttggtttagtaaattagttttattaactttatttattttaatgtttttaaattgcagatttgctgttgctgagtctgattgtaatttagcagttgccttgaatagaagttatacaaaggcttattccagacgaggtgctgctcgatttgctttgcaaaaattagaagaggccaaaaaaggtattttctagtcactctctaaagaattctttaacagtgttatctcacagatgctatatggagaatactgagtaatcacagttactaccttcagagagctttctgtatttgaacaaaggtcatttttgcaactgaaatgatatcttgatgtttttaagaaagaatgcattatttgccaccaatcagaatttggttcaaattctcatgttactaagtactaactatgtgaccaatatctcctctgattttcagtttctcatctgtaaaataggcattaatatgtcttgttggctttagtgaggcaagaggtagtgtgtttaaagctcataacacatttttgttcacttataaattctaagccttctattatttcataaaataggtttgtgtattacaaatcacaaaatctgaataaagctgatatttaattggattttgctgctgcttaggtttttttttttcttttttttttttttgagacagagtcttgctttttcacccaggctggagtgcaatggtgtgatctctgctcacagcaacctccgcctcccgggttcaaatgattttctctgcctcagcctcccaagtatccgggattacaggtgcccaccaccatgcctggctaatttttgtaattttagtagagacagggttttgccatgttggccaggctggtcttgactcctgacttcaggtgatctgcccacctcggcctcccaaagtgctgggattacaggagtgagccactgcgcccggcctgcttcttggttttatgatatacaacttatgatagcaggtatccttcctggggctggtggaagatggtttgtcataggattttgtctgccctggggggagaagaagaaagttcagtggcttggctctgcacagtggcttacgcctgtagtcctagcactctgggaggccaaggtgggaagactacttgaggccaggagtttgagactaacctgcccaatgaggagaaaacctgtctctactaaaaatacaaaaattagctgaacttgttggcgtgtgcttgtagtcccagctactcaggaggctgaggtacagaatcactggaacctgggaactggaggttgcagtgagccaagattgcgccactgcactcagcctgggcaacagagtgagaatctgtctcaaaaaaagaaagttcagtggcctaatgatagtatttctttgtttctcctttattttgctgtaggacagttgcctgattgtcacaggcaacaaaagattgttttgtacatgttttaaaatattacctatctttaaaaattttttttatcttctcttttacttagattatgaaagagtattagaactagaaccaaataactttgaagcaacaaatgaactcaggaaaatcagtcaggtaaactatagttatttaaattaagtgtattatgacctttatttgaagaagtaaagctttttgcatagattttgtactatagatttcttaatattgagattttctaattttaattctttgtactatagagttttactaaatgaatttgcatgctagagggagtgtaatggtatttaaagacccttgattgttctagaagttgcctgagatctttaagaactactgctgctttactctttctcagatgacagaattattatttttttatcccactgattttcttcctttttggcttatgcactgactgaaacattgagagaaaagtgacagtgattggggaaagtgtgcttttaaatattaccactactattgcacataagatctggtaaatatgttaacttgattatagttgtgaactgtattacatatgtttaaaattttgccttaggtcaaataatgactgtgaatattgaatttgagaagtttggtgatgtagttgtaatgaactgttatgtctgaaaacagctcctaaaacagtgtctggcccgtatagaaattcaataaatatttgttgaataaatgagcaactacttttaatggatgctacttatttatttatttaaaataattcaacttgtattttagattcaaagggtacatgtgcaggctttttacatgggcatattgtatgatactgaggtttggggtatgaatgattccgccacctagatagtgagcatagtacccaataggtagtttttcatcccctcccctccccaccccaatgtttctctccccaacaggtagtctatagtgtctgttgtttctgtttatgtccatgtgtacccaatgtttacctcccacttataagtcaaaacatgcagtatgtggcgtttgatactaattttaattgaaatgagaagcacattaaatttattatatgcttattttactttttactttaataagtagaaagattttgaattagagcagaaaatgttattttgattatttaaaatgtggcagaaattctaatatatttgaggtatttatgttttaaggtcaaatatatatgcatcttgcattactttgttttattttagctgactgctatgtctcctaggctttagcatccaaagaaaactcatatccaaaggaagctgacatagtgattaagtcaacagaaggagagcgaaagcaaattgaagcacaacagaataagcagcaggccatttcagagaaagatcgggtaatccaaagctattccaacgtacaatgtatatgttttgctgagtgttgatttatttcttgtatatcagttaatttctttcttctctaatattaaagttttgcttgagtaggaattgggaattaaatgcactaaagcctctgggacctactaattcaaaatttgggtaattgatgactttatatataaattaaaaaaataactatagaaacacttaagtttaggaaactacttttgaatgttttatatatttacatatacatagttataaatttaacatagaagttaattacaatccattcttataatgtacttttttcattaattcacactggactgtttctgattgaaattcctctactaatcatgagttgaggtttagtttatttattgcctttcctggacccacagaggattcctaataaatatttatgaaatgattattgattgtgatatttgactgattataagtaaatgttatagtgaaatcaggtatacaaattccaatacagctgaatttatcttatatttgggcatattaaagttattgaagagtgggctttataattctggtactgtattctttcacaaaatttatttgagttatgaagtccttttgtacagcttctaatgtaacttaagacagtatattatttggacctttgttaaaataggtttttaaatttaagctttgcgtaatatgtaattaatggaataatagtgaatgctgcaaagtaatgtagtatacatgtttttcctttttagtactgaaaagagaataatgccattaaaaaagaaacaacccaaaccaacagattttaaaacgtgtctcatgggccagatttttaacaatattctttcttgaaatactgttggtgaatatccttgcagtgtttcataagatttgaattcatttattttttttgaaattttttttttattctccatatctctctacaaaataacaggggaatggatttttcaaagaggggaaatatgaaagagcaattgaatgctatactcgagggatagcagcagatggtgctaatgcccttcttccagctaacagagctatggcctatctgaagattcagaagtaagtattggttacattttagtgctgttcaggataaaaatttacaataaattggtaaatttttaccataagttacctaacatgccaattatggcgtgttaggttagctcacatgccaatttatggtaaatttaagtaagttaaaatttaatttatgtatttttgagcatttaaattaaagtgaaatgagaggggaaaagtagtgtgtgtgtgtgtgtgtgtgtgtgtgtgtgtatgtgtatgtgtgtgtttatgtacctgtggtatacatagttccaggcacaaggtgtgtattcagtagatgttcttgttaatattttcccgcttttaagtctggcattacacagtttaccagtttttctctagtcgctttatgtatagtattctggatcttgattaaaaattatttttcacttcagagccccttgggcaaagtcttatctggaaatgttttatatacatacatgtataacaaaagagaactgctgtcattgaaactgctgattaataacatatgtaacaaacatttgatcctatattaaccagctttttctggttgtgcccaagttggacaatcagtagaattatatccgatggcagaaacttagacttagactttgtttctcttgttatactttacagactaatgccagaattttaaaaagcctgtaaatagtataaataggaattcgaaacttcttcagtgccatgaattcccctttagctgtatgttgaacgcttctcaggatatttttaaatgcttaactgtacaactaggattacaaaggaaaccaattatatcaaaatatagttttgaaaatattaaaaattgtgatatagtagtatatttgattttttattaacacacctcaaaatgagaaattacatttaaaatacaggcaagtgctgtattttatgctcaccaatattcagaattacagtacaaatttaacctgctgcttatttgcatgtgattgtactgtatttgaaactacatttaaaatacagacaagttaatgttaaaaaaattttaaagacatgattgtaaggtttcagtaaggacaccaaattttgggatgatcctcgacacatcttccacgtactgatcaacaagcaagtgtggatagggaatacctgaagcaacgtagatgattagatttccaatgtgataacacatgccttagctctttgtcttctgaataactactagggcagagttgcccaacagttgccagccttgtcacaagagtatctataaaccagacactgcaatcacatgcaaataagcaacaggttaaatttttactgtaattctgaatagtggtgagcataagcaatattttgagataccagtaaccgttataatgtgatatggaaatatctgattttttttttttttttgagacagagtccccctctgtcacccaggctggagtgcagtggtgtaattttggctcactgcaacctccacctcccaggttcaagcaattctcctgcctcaacctcccaagttgctgggtctacaggcatgcgccatgacacctagctaatttttgtatttttagtagagatggggttttgccatgttggccaggctggtctcaaactcctgacctcaggtgatctgcccgtctcggcctcccagagtgctgggattacaggcaggagccaccgcgcccggccaaaatatctgatttttattggtgacaaagtgatagatactattgtctgcatttgtatttgaaagatagctaaattttatttgaagtttagtgaaaacagtgatacagtttttttcctaaacaagtttccacatccctcagacaatctcaggttaggagctcctgtcatagaaataaattctgattatatatttaacctcatttaaagtaatagatatcactggagatagattcttttgttgactagtcagagtgaagatcattgcatctcttgctcacttatgaaaattttgatttttgctatcgaagaattgtgcattggtttaaaaattgtaaagcctgagttcgttggtttgactaatgctaagagtaatgccttcttacaggtgagagattatatatgcatttataagatatctaatttattgtatcagttttatttctttagtttataatcgtattagtggaatatattataccaagttagcagagtatattttaaattaaaagaacttatgactcttacttgtatcttttcctagtgtatcttttagattcacagttaatatcagaatttttttctgtacatggagactgttgttatgtattacggactatgtgaggaacataaaaaagcaacatttcaagcttagactactcctagtttaggtaaccatcctatagcttgaggttctataaactgtgtcaaattagagctaattagaaccagcagtatagtcagtcttacctaccagtgtgcggggtagcagtagggagtaagaagaaattcacctagttaggccaaccgggattcctagagaatgtgctttctggaggtgatagtctaaattagtagtttgcattgggagatgagcaagacatccttgagttacaataatggagtgcctgtgagctggcaaattgtggaatgtaggctggtagatggttagcttcagaaaggctgaagaaataagaagataatcagaaataaggacagaagtttgggccaacattgtagtccttgaagaggactgaccaagaacaaatctgagtcctattcttagagggagtaaagcatagatttagagataggataagaagaaaataacccagtagtattagatattagatttgggaaacagggttgagagttggtcacaaaaataaggtagaatcttggttgctggaactggaaccagactaagacttgatttagtagagggtggttcacttaatggtgattaggggcggcatttacactagagccagagtagacctagggcaagtggacctgactgaaaatcagaaggaatcagggctaaggagctaggcagagatgatagtttttcgcactcaccatttttattctatttttgattagtttgtctttttctccaaccacctaaaagatgtttgttgattggatttttctaaattcactttacaaatggagtgcacaggagacgtgtaataattttaaaggacttaggtgagtctattttcaaagaataatcgtctacctctgtggcaacttcagacttttagaaaaattgttgggttttcttcagctgtacagtagaacatgcaattaaatatgcaattaaatatacaattaaaatgatttcctaaacatttatattctaaattttctttgaatttgggtgttggaaattttttgatttacttattcagcaaatatttattgtgctaaaatgtatcaggtgttctgtgaggcactgtggaaggtattaagtatacaaatattaaatgtatagttgtttttaagaaacccgaaatttgcagggagtgacagaaaaggagaccaatatttgtgaaaatacgctaagatagcgctatgaaggacacgtgctataggagttcagagtgggaagaatactggcatagactgagtccaggcaggggaattcctggaaagcatcttgaaattgtttaggagtagtatgagttagtgaggtgaaaaaacaggaaacaggtcaagtgttctagtgcaggttcaaagacgtgggagtaggcaggttgatggtacctcaacctggaaagggtgagtggttcgtattatggctgttattgcaggggacagtggcagagagaaggccagatactcaggcaggcccctgactttgcgctccaaaggaattggactttatcttgaaaagtatgggggccatgcaggtatcttgaatgatataatcaggcaagtagaaaataacattgataagggcatgaacacagatatattctttatctcttgctggaaagtgagttaaataaatcagagatgtttaagttcattcgaaattctgatttttttcatatgagattttgttttgagggcaagatgacatccatttaggccttggggagaatgcaattacaggagtgttttttttttttttaatattcttatgaaacttttcaaacttatacaaaagtagtataataaactccatgtgtccatcatctagttctaacaagccatactttttttggtcatatttgtttcagcattttccccccgaattattgtaaagcaaatcataaacattatgacgtttattgctaaagaaaggatattttatacataaccacaaccattagcactcctaagaaattaacaataattcattaatgtcctattaatatatgggaatgtctgaagtttttttgttattgggtttttttggtggagggggttgagctcttcttaagcaccttgttgttgtagagcagtaatgagtaagtctgtaagtctgaattgattgctggttgcatggctgagtagaatttatgcaaagtattagatgatatgctatcacattcgtaccaagttctcatttttttgtttttctatgagtatgggaggtttactgtgggtaaatgttaataaagttttattagaaaactaatgccagtcaaaattctaatgtaatacctgtgcatattgagacttggagaagaggtaggcagagaagcagtggcattcttttgtctgccctagtcatatttttgcattattatttcatcgctccagcagactctcctaacattccctcaatctggtaccttctccctcctcaccaaatgattccaggatttggtgagaataaaaaatttataaaatagttctccacttcaaacacagatttagaagttagtgattgaaattatatacaagctttttaaattagaaacttagtttatatgacatttttccataagctgccttttttccagtcagtaattttatcatgttcaatagatatgaagaagctgaaaaagactgcacacaagccattttattagatggctcatattctaaagcttttgccagaagaggaactgcaagaacatttttgggaaagctaaatgaggcaaaacaaggtaagactttataacagctggcactcagtcatcctgatgagtgcccaagttaaagaagcagagattcatgtagcttacccatggttcaaagatactgaacttagggaattatgttttctttccacagtttagatcacgaatagatttggaggaatgcagcttccgcaatgtaccagattatctttttgtttagtagcattctggctaattttgtttagtacattctggctaattgccagtcaatattaatgaaaaattttaattatacatgagaatggaaaacgataaaaagaccagaatggaaaggaagggaatcggtgttgttgagcgaaagggactcactgtgtgatatgcttgaagccaatactgtgacatcaggtttttgagaaaaggctttatttatattgaaagttgactcctaaagagacaggaatcaaacccaaatctgtctccttgtcctggccttaaggcagtaattttattagaaagggtttagggaggtggatactggaattagcaggtaattagtggaaggaaagggaaaagttcttgggcatatgtagctatctcttcttgctaactaatgggattgcaggtgcaaatttggggtagttagtagaacttggtggaaattcagtttgtgacatcagcaaactcgtttttgtgcaaactccacttggccatcttggttccaaatgatttcagcctgtttttttttttttgtttcgtttttttgtttttttttgaatcccagtaagcagaggaagtttctttgtttcagcaagttgtatcttttcctatctgccatcctacaaactgaagaatttctgttagtgattgattttttttttttaaaaaactcttcgggctgtggttttatcagcaggtagggaatggaggataatggagatctgataccattttaattcttgatactattttttttctttgtttttatggtcttctcttttagggtattcattgaattagtcttttcagagaaccaacttggttctcctgtgtgtgttttctatttaatttccttctgctttttattttattccttcaactttcttttggtttaatttgctgtttttctagcttcttgagatcagtacttagataattgattttcagcctctgttctttcctggtatgtgcatttaaaatctggcagtttctctataagcctgttagctacagcagtgttttttttattgtggttaaaaaaaatatgtaacgttaaatttattattttaaccatttttcaatatatagctcagtggcattaaatacatttacattgtgcagccatcaccactgtccatcaccagaactttgtcatcatcccattctaaaactctatacacattaaacaataactctccattctcctctcctcccagccctagtaacctccattctactttctgtctctgaatttgactgttctagatatcctatgtaagtggaatcatgcagtatttgtccttttgcctctgcttatttaacttagcataatgtccatgttggagcatatatcagaatttcattcctttttaaggctgagtaatactttgttgtatgtaattctcttattctattaatattttacatttagtgagttactctgtcatttgtttacatggtgaactttgctaagttagatgacctctaggggcctcagttttatcacctttaaagtggggttgtagtgagggttacgtgaacattcatataaaacaactacaacagtgttcagtaaatgttcttactatagctcacctgtttcctagtaatctgagtaaaactgcttgagctaaaaatgtgattactaactgaatatatcatgaatatacatgcgaatatgaaaactccacattttaactatgttgtaatgtttttaaaaaattcgctttagattttgaaactgttttacttctggaacctggaaataagcaagcagtaactgaactctccaaaattaaaaaggtaatgtattcttttcacccaaacatggtcatattttctgaaacataaatatatttatttgttgtataataaatattttgaaagttagggttataaatttattttcaaggaattaattgagaaaggacactgggatgatgtctttcttgattccacacaaagacaaaatgtggtaaaa

SEQ ID NO: 12938 - DNA, 390 bp, Homo sapiens
agttgggagagagcaacaacagcagatgcaaagaccctgaagtgggaaagatcttgaacgtatgaagtgggatgacaatggtttgatgtgagattggagaggtactaagagccaagctgtgtaggaccttagggaccaggataaggagttgatcgttgttctaagagcagtggaatgccactgagtagctgtaagtgtgatatttacgtggtctaatggattgattgattgattgattgattgtagagatgggatctggctgtgttgcccaggctgatctcaagctcctggcttcaatcaatcctcccactttggcctcatctcccaaagagctgagattataggcataagctaccacactcagcatgatttatgtattttgaagctcat

SEQ ID NO: 12939 - DNA, 308 bp, Homo sapiens
tcctgcctcagcctcctgagcaactgggattacaggcatgcaccaccacacccgactaatttttgtatttttagtagagacagggtttcaccatgttggccaggctggtctcgaacttctgacgtcatgatccgctctcttgacctcccaaagttttgggactacaggcgtgagcgaccactcccagacttagtgagtcttacgatttacacccagagtcataaactattatgtcagcattactgtatcagcctgtaagcgagtcattaagttcaggccacactcacaggaagggaatgaagctgcac

SEQ ID NO: 12940 - DNA, 578 bp, Homo sapiens
tttttttttttttttttttaaagcaaagtctcactctgtcacccaggctggagtgcagaggcacaatctcggctcactgcaatctccacccaccgggttcaagtgattctcatgcctcagcctcccgagttgctgggattacaggcgcgtaccacagtgcccagctaatttttgtatttttagtggagacagggtttcaccatgtcggtcaggctagtcttggactcctgacctcaagggatctgcctgcctcagcctccgaaagtgctgggattacaggtatgagccaccactcccagactcccatttgcttttaaactattagtaactctccatgacactgagtttgctgctgagtttcctgacatagcatcatcagagataatatttggttttaaacactgaacaaaattagaaagctgctcaagaggtcaacactagggtgtcaacacattgccttggagaaagaaaacaatgaactctggaagctttttaaaaagaagagttgtaaaacaatgccagtcccttgggatgattacgagcttgggaagaaaaatgtggttagagctaaatgttga

SEQ ID NO: 12941 - DNA, 148 bp, Homo sapiens
cccagctactcaggaggctgaggcaggaaaattgcttgaactcgggaggtggaggttgcagtgagccgagatcacgccactgtactccagtctgggcgacagagcaagactccatctcaaaaaaaaaaaaaaaaaaaaaaaatatata

SEQ ID NO: 12942 - DNA, 415 bp, Homo sapiens
tttgccttttttttagtggaattatttgtttctagcttgcttaattgttttaattccatgtaggttctagatgttagacttttgtgggatgcatagtttgtgagtactttctcccattctgtaggctgtctgttacctctattgatagtttcctttgctgtgcagaagctttttagtttaattaggccccacttgtaaatttttgtttttgttgcaattgcttttgaggacttggtcataaattctttcccaaggccaatgtccataatagtgtttcctagattttcccctaggattcttaaagattggagtcttacatttaaatctttaatccatcttgaattaatttctgtatatggtgaaagataggggttcagtttcattcttcagcatatggctcaccagctatcccagc

SEQ ID NO: 12943 - DNA, 279 bp, Homo sapiens
cacgcctgtaatcccagaactttgggaggccgaggcaggcggatcccgaggtcaggagatggagaccatcctggctaacacggtgaaacctcgtctctactaaaaatacaaaaaaattaaccgggcgtggtggcgggcgcctgtagtcccagctactcgggaggctgaggagggagaatggcgtgaacctgggaaggtggagcatgcagtgagctgagatcgcgccactgcactccagcctgggtgacagagcgagattctgtgtttaaaaaaaaaaaa

SEQ ID NO: 12944 - DNA, 738 bp, Homo sapiens
aaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaa

SEQ ID NO: 12945 - DNA, 105 bp, Homo sapiens
tcacgcctgtaatcccagcactttgggaggccgaggcgggcggatcacgaggtcaggagatcgagaccatcctggctaacacggtgaaactctgtctctcctaaa

SEQ ID NO: 12946 - DNA, 123 bp, Homo sapiens
cagagtcttgccctgtcacccaggctggagtgcaatggtgtgatctcagctcactgcaacctctgcctcccgggttcaagcaattctcctgcctcagcctcccgagtagctgggattacaggc

SEQ ID NO: 12947 - DNA, 343 bp, Homo sapiens
gctttgattcctcatcagtggttcttaaacctcatgttctctttaggtaactctgggagcttaaataagcatcaaaagttgttctgatgacacgtccagctattcaaataaatgttcaaattgtagattttattgtttccatttgtgcaatgtattttttccttccaacttctattttaggtgcagaagtacatttgcaggtttgttatataggtaaattgcatgtcatggggtttggtgtacagattattttgtcacccaggtaataagcatagtacctgataggtattttctcagtcctcactctcctcccaccctccaccctcaagtaggccctggtgcc

SEQ ID NO: 12948 - DNA, 138 bp, Homo sapiens
caaaaaattagctgggcatggtggtgggtgcctgtagtcccagctactcgggaggctgaggcaggagaatggtgtgaacccgggaggcagagcttgcagtgagcggagattgcaccactgcactccagcctgggtgac

SEQ ID NO: 12949 - DNA, 701 bp, Homo sapiens
ggatactctgcttttgaggggaaatggaatatgggattcacaggagggtgaggatgactgtatctcttatacaccataatgacaactcatccttctgaaattttcccaattctgtatattaatgcatttagtctctcgaatgttagaacgattctctactaatcccacttgtgaaaacagaattgttagtatatttatggttgaaatgtataggttaccgtgataaactttgtatcttttttttaatgttcttggctgaatcaatctcttcgttttatgaagtctgcttatatatctagcaagatttttagttttcatcaataatatatctatatcccacatattgagtctcatgataacattaattctaggtagctatttagtattatctaatctatttttgacttatcctacaaatagagattaaaggaggaaaaatttcccataaagtaaccagaccataccttcatgaatgaatactctttagtctgtttatgaaaatcatgatttataattcgtttaatttatttatcaaacaattaggtttcaatatacataagccctgtagcttgttagaatctcctacagagtgagtaaaatgcagtttctgtgtttgagaagtgtaagatctgtccttatctataaactcagcataaaactgataatgacaacaacaatatattgatgatgatgatgataat

SEQ ID NO: 12950 - DNA, 512 bp, Homo sapiens
cctgtgtccatgtgttctcgttgttcaactcctacttatgagtgagaacatgcagtgtttggttttctgttcctgtgttactttgctgagaatgacggtttccagcttcatccatttccctgaaaaggacatgaactcatcctttttgtggctgcacagtattccatggtgtatatgtaccacattttctttatccagtctatcattggtggacatatgggttggttccaagtctttgctattgtgaacagtgctgcaataaacatacatgttcatatgtctttatagtagaatgatttataatcctttgggtatataccagtaatgggattgctggatcaaatggtatttctggttctagatccttgaggaatcgccacactgtcttccacaatggttgaactaatttacactcccaccaacagtgtaaaagcattcctatttctccacatcctctctagcatctgttgtttcctgactttttagtgatcgccattctaactggcatgaga

SEQ ID NO: 12951 - DNA, 238 bp, Homo sapiens
tccccatctttgtggttttatctacctttggcctttgatgatggtgacgtacagatggggttttggtgtggatgtcctttctgtttgttagttttccttctaacagtgaggaccctcagctgcaggtctgttggattttgttggaggtccactccagaccctgtttgcctgggtatcaccagcggaggctgcagaacagcaaatattgcagaacggcaaatgttgctgcctgatcctt

SEQ ID NO: 12952 - DNA, 421 bp, Homo sapiens
cttctccctattgaacttgttctcacctgtgatccatgtttgggatatattctctaatccaggtcacagcaacttggctgagtcccttactgaaagtcacagggcctgtcaaacagccctcatcaggtctcagaaactcccaatttcccttgctacttcaggcttaagagggtggaaacagcttagagttggtgctggtgctggaaatggaaataccaaatattgtttcctaaacattcatgcaattctattaataatcgctttattaaatttcccatttgatcatgtcaattaattctttccaggatcctgactgatacagtgcctatatttatgaattctttcagaatttaaatatctcatctttgattttcagaaaccacccacagtctaaagattatgtctatgactttgcttatgc

SEQ ID NO: 12953 - DNA, 215 bp, Homo sapiens
gttagatttaagtctttgatccatcttgagttgatttttgtataaggtgagagatgaggatgcagtttcattcttctacatatggcttgccaattatcccagcaccatttgttgaatatggtgtcctttcccaactttatgtttttgtttcctttgttaaagatcagttggcttaagtatttggctttatttctcagttctctattcgattccat

SEQ ID NO: 12954 - DNA, 390 bp, Homo sapiens; identical to SEQ ID NO: 12938

SEQ ID NO: 12955 - DNA, 390 bp, Homo sapiens; identical to SEQ ID NO: 12938

SEQ ID NO: 12956 - DNA, 281 bp, Homo sapiens
gcctgtaatcccagcactttgggaggccaaggcgggcagatcatgaggtcaggagatcgagaccatcctggctaacacagtgaaaccctgtctctactaaaaatacaaaaaaattagccgggcatggtggcaggcgcctgtagtcccagctactcgggaggctgatgcaggaaaatggcgtgaacccgggaggcagagcttgcagtgagccaagactgcaccactgcactccagcctgggcgacacagcgagactccgtctcaaaaaaaaaaaaaaaaaaa

SEQ ID NO: 12957 - DNA, 7286 bp, Homo sapiens
ctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggaggtaagagaccaattagcaaatggtctgtggcttttgtcacagggcccataataaataaataaacaaaacaaataattgagtccaaacactgccaagttcactaaggcatggaaactggaatttactattatcactaacaaagaatcatgataatctttttaacattttcataattaattcatctcttgatgaattaattcatctgcctaaggttgtgaatcactttctggaggtaagagactaattagcaaatgctctgtggctttcatcacttacagggccagcccactgtgatgaacccactattcagaagcggggcaatgaacaaattaattattgaaaaacagaaatggctaaaatctacaggtagtgaagactggaaaaaaaattaatgaagatgattatgaatctttagtatataactttctgcattttactagtgtataggcatttcaagtgctttgtggcaacagcttagccctaaataggaagttagaataaaccaattttaatataatattttgttttacagaggtttttcaggatggatatatgctttattttatagaaggcaaggtctaaatggaacctagagaaatatattataattttaaatgcttagacaaaagatagggtaaaccaaataatgtagtttttacaattctgttttggtaaacctaaaggtaatttcactgtgatggacaaaagagttcagtccaacccaaatatgtcctgctttcacgctaatgtgtgtcttctcaataagcctaccaagaaaataggaatgagaatctattcccccaaatcaagggccatttgaaattgaccatattctaattaaacacttttttaaaacccacatatatacacagtacaaccttttctcctttacattcaaaataacaaaacagtaaaagccttttatttaaggcttttgcttagatttagtagcttttcattggaagagggtacagagtataagtagagaggtgttcatttattaattggaagagggtatagagtataagtagagaggtgttcatttataaatttaataaatatttctagagctcctgcttggcaccaggtacagttctgagaatcagcgacctagcatttaacaacacagattagatgtgtaatggcatggtgcttacatgcatgggagacacacaagcaatgcataaacaaaatgagtaattttgtttatttgtttatgacctgttatattacatgtgtttgaattttgagatcacgaatattaattttttgttttaaaagataggatattattttctattgttacagcagtaatttttaagaaatatgttaatataaacaaaattttgatagtattcttaagacatacccataaaaacattttatttgactatttatgatctaacaacattaacaaatacatgttaattgtttatgtgcttctttactagcatttctttgggcagaaagtttttttgaactgagtaatttatcatttttagcgttgcctcatcagttcaccaatcaatatatagattactgatcttttacttgttatgggctcaaaactgtagtaaggatttctgcagtggggattacttaatttgattttctttttttctttcttttctttcttccctttagacagagtcttgctctgtctcccaggctggagtgcagtggcacaatctcagctcactgcaacctctgcctcctgggttcaagtgattctcctgcctcagcttcccaaatggctgagattacaggcacataccaccatgcctagctaatttttgtacaggtttcaccatgttggccaggctggtctcgaactcctaacctcaagtgttcctcctgcctcggcctcccaaagtgctgggattgtaggcatgaatcgtcatgccgagcctaagttgactttctactatcattttcacttatttaaaaaaatagaatggatctattggaaaaaccataaatcattatttgcttacttcctaattgattcattttaacatagaccttttagtttttttcactatccaaggatttagttaatgctatcatctgttatacaaatcgcactcacttgctttcttcctgttgcacagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcaggtaagatcatggctctagggtctccaaggggtgcgggcaggattatgaaatgaaatgtgatcgatcaaaaattttgctgattgggaagaaaacatcatctctgaactgctctccaaacactggtgcttttaacacttggctttattctacctacaattatgtagaaatccactgagtataaaaataaatcgatacttttttcagacatgtttctaatataattatcatgactatcatattctgttgagcttcgtgaaacaaacagcaagatcctctagctagcttgaaaagctccggaatcgtgaagctgttttttaaacatcaggatagtaaatttctttatgattataactttgtgattatattgacacatgcaaatattggggacataaggcaaaaaactgaagaattcaggccatgatcatgccaaataatcaggattaaaagaaatatcttatgtaaaggacctagagcagcacttggcacaaagtaggtattcataatacatatgaattatgctgtattcctactagtatctgagtccatgtaggtattcataatacatatgaattatgctgtattcctactagtatctgagtccacgtaggtattcataatacatattaattatgctgtattcctactagtatctgagtccacgtaggtattcataatacatatgaattatgctgtattcctactagtatctgagtccacgtaggtattcataatacaaatgaattatgctgtattcctactagtatctgagtccatgtaggtattcataatacatatgaattatgctgtattcctactagtatctgagtccatgtaggtattcataatacatatgaattatgctgtattcctactagtatctgagtccatgtaggtattcataatacatattaattatgctgtattcctactagtatctgagtccattttggactgtctagaatttcctgaactgttagctgtttatagaataaaaatgaattcaataataataatatccacaataaggtaaataacatcaaaaacacttaaagtaattttagtcttgattaacttttcatgtggataactgagaactgatctggttattaccggttttttgttttttggttttttgagacaacgtcttgctctgtcacccaggctggagtgcagtggcatgttcttggctcactgcagcctcaacctccttagttcaagcagtcctcccacctctgcctcccaagtagctgagactacaggcatgtgccaccgtgcccagctaattttgtttattttttatagagatgaagtctcactatgtttcccagcctagtctcaagctcctggactcaagtggtcctcctgcctcagccttccaaagtgcagggattacaggcatgagccaccgcacccagctcaactggttgttattgttatgttggtgtttttgcatggcaatgccatccgcctgacatattgattgtgcaacaatcaatatgttgcacaaaatatctactgagccttgtaacagcttcctaaatccaaggatagatcagaaactatattgtacttcatttaaggcactcatttttgcatttccattgcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcaggtaagattctgtcttaattagaatgtgtaatgcctacatatacatatattgccaagcaagcagtatctataatagtaatcc

SEQ ID NO: 12958 - DNA, 409 bp, Homo sapiens
taagattcaggttaaaatttgcatagatacaagagatgtgggaattagtcaatatcagagaaagatgctgaggtaatttccatttcagaaaatttatctagctttgcctaaatggataaatggagacatttgaagcataagagtttggcatttcatgtcccagcttagaggacttccacttgaaacagaacaattggtttgaagcacagtatctagatcctttctccaaagagaaagaaaattgcccattcaaccagcaattatctctaattaaggaatggaagcacaagttttcggtagtatcactacctggcagtctgcatgcaatcaagcaaggcaaggttcctatatccacaggagttttttcttgactagaaaaaaaaattaggataattaagcaagttgtagc

SEQ ID NO: 12959 - DNA, 2362 bp, Homo sapiens
tagaaataattttattatttattttaaagcagttcaatgtaactggtagcaaaatggtacagacaataaacagaatcaattcccattgggctacaaggactattattgactttatattttattttcatgtgcaagtataattattttaaaaaggcaacatttcattaaaagtcttttataagcatgtttttattctttaaataacagaaagactaataaattatcattattgtagcaagctggtatgaactgtgtcaaatattaaatttggactaatgttcatagtcaaaaataattattttaaaatttatgaaacaaaatttttagttatataggaaatataatcatatcctagcttaaaatcctagtctcaacaactgtcataatgcaaaaataccaaacttcagatcttgtggggaaataaaagatttgtaaaatcttacatttattcctaaaaataatgaagtaaaaaaagtcaacttaaagaaacatcatacttgactcttgatatgcaaatataaaacaagttcataaaatttattgtttttctctgttacatatattagttccattctgccttcagtttttaacaatttatatgtgaatgtgtgtgtcaaatatatttcacgtttataacatatacacatatatgcatacaatctttaagttttaaggcatgctcccaattttagctaacctgttataaattctacttctctgatcaaagtagattaaatacagggtctctgttttaggggtaattcttggtgttcttgttattctaaaatgtgaataatgtaaaatacctaaaagaaaaaaagacatttcatagcctccaagccaaattatacaatgactataatctttgatttcacattgcactttacagttttatttctgtagaattattgagagtacattagaatatcttttctttaaaaattttattatcctttaagttgatctgcttcattatgaaaagaaaggaaaaaaagtccctttctagttttatatgtattttttgttgttgctgaattaaactcaatgtcaaattcaaaaattaaaaaatacaaaattagaacagtatgtatttaaatttaccaatgtttcttttacaggaacattttaacacacttctactacctggtaaactatgtacgcatactcttgtgctcttttgatctatttctctagggggaaaatgcatatacaggtttattaattgaatcactggaatatcatccaaggtccgatttatatttaaagttataactcaaatttggcatgattcgcattaatgttaaaagccaagaactacctattttgttttatgcttttctctcataatgttaaagtatagctcatatatacgatttcaaaattaagtcaaaaattttaatacatccttcattgagtgttattgtttcattaccaaagacataaggacttttaatgttttgaagtgtcttcagagtccataaaaggtataaattatcttctgtcaattttaaaagaatttttctagtgaaatttactatatagatatatgaataggaaagatggtaaagttcaagagtctaaggacaatcattactgtatatttcaagatatccagttaatttttcaatccttgaattaaatttaagtcaacaaatgtgtattaagtattttctctatgctaggcattcgtttaggagaataatagatatttgctttatagtatgcttttcttggcataaaatatttgctagacataaagttaccaaaaagtgcaggaacctagtgtttcttttcatttatgttttagtttcttcaatgtaataaaacatgctatgaacatctcaaattctaagataaatatttttatatcgtaaggcagaaaaaaaagttaaaatgacttaaagatttgtattctaaagcaaactatgattcttacacaaaagtcagccacacaagtttgttggttaatctctatgtgagaagactagacatttacgatgagctcaattttgtaaaacagtaagtttaaagaatataatatgacacatttaatttttaagaggagcagcagcattctgtgtccattgtgatgcaccaaatatagttagattttgtcaacttcataaaaccttaataatttttaaaattgctttcatagagtttggattattataaaacaattaaatgtcagatttaaatttttgtattttaatttagcttttcaaatttattccattgaggtccttcaaatattaatagggagagtaccagtaagtagtacattaagtttcaaaatgatctatacttctaagagaagagattacgtttttaaatatgagagaattacatatatttccatcta

SEQ ID NO: 12960 - DNA, 209 bp, Homo sapiens
tggctaacacattgaaaccttgtctctactaaaaatacaaaaaattagccgggtgtggtggcaggcgcctgtagtcccagctactggggaggctgaggcaggagaatgggatgaacccaggaggtggagcttgcagtgagccgagatcccgccactgcactccagcctgggcagcagagtgagactccgtctcaaaaaaaaaaaaaaaa

SEQ ID NO: 12961 - DNA, 1046 bp, Homo sapiens
  misc_feature (791)..(791): n equals a,t,g, or c
cagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctngtgttgcacactttataagcaattaaggccaattgaattaagtttccaaagagtaatctaggaagtggtcatgggctacatgtgtctccatggtacagcaaagtagtttcagtattttcccctattttgctatatttcttgtagattgaagtattattgggcttttttttttcccatatgtttttctgttgttctaaacattgtgttctactgcaattccaaacagctctctgtttccctcttcttggaagagta

SEQ ID NO: 12962 - DNA, 282 bp, Homo sapiens
tttttttttttgagatggagtctcgctctgtcgtccaggctggagtacagtggcgcaatcttggctcactgcaagctccacctcccaggttcacgccattctcctgcctcagcctcccaagtagctgggattacaggcacccgccaccacgcccagctaatttttttttttttgtatttttagtggagatggggtttcactgtgttagccagaatggtctcgatctcctgacctcgtaatctgcctgcctcagcctcccaaagtgctgggattacaggcgtg

SEQ ID NO: 12963 - DNA, 970 bp, Homo sapiens
ataggctcaaaataaagggatggaggaagatttaccaagcaaatggagagaaaaaaaaaaaaaagcaggggttgcaatcctagtctccaaaaaaacagacttcaaaccaacaaagatcaaaagagacaaagaaagccattacataatggtaaagggatcagttcaacaagaagagctaactatactaaatatgtatacacccaatacaggaggacccagattcataaagcaagtccttagagacctaaaaagagacttagactcccacacaataatcatgggagattttaacaacccactgtcaatattagacagatcaatgagacagaaagttaacaaggatttccaggacttgaactcagctctgcaccaagcaggcctaatagacatctacagaactctccaccccaaatcaacagaatatatattcttctcagcaccacatcacacttattccaaaattgaccacatagttgaaagtaaagcactcctcagcaaatgtaaaagaacagaagtcacaacaaactgtctctcagaccacagcacaatcaaattagaactcaggattaagaaactcaatagaaaccgcacaacaacatggaaactgaagaacctgctcctgaatgactactgggtgcataacgaaatgaaggcagaaataaagatgttctttgaaaccaatgagaacaaagacacatgtacaagaatctctgggacacatttaaagcagtgtgtagaggaaaatttatagcactaaatgcccacaagaaaaagtgggaaagatctaaaattgacaccctaacatcacaattaaaagaactagagaagcaagagcaaacacattcaaaagctagcagaagggaagaaataactaagatcagagcagaactgaaggagatagagacacaaaaaacccttcaaaaaaatcaaagaatccaggaggctggttttttgaaatgatcaacataat

SEQ ID NO: 12964 - DNA, 359 bp, Homo sapiens
tgcccccagaggtggagcctacagaggcaggcaggcctccttgagctgtggtgggctccacccagtttgagcttcccagccactttgtttactactcaagcctcagcaatggtgggcgcccctcccctagcctcactgctgccttgcagtttgatttcagactgctgtgctagcaatgagtgaggctctgtgggtgtagggtcctccgagccatgtgcgggatataatctcctggtgtgccttttgttaagcccattggaaaagcgcagtattagtgtgggagtgacccaattttccaggtgctgtctgtcacccctttctttgactaggaaagggaattccctgaccccttgcacttc

SEQ ID NO: 12965 - DNA, 239 bp, Homo sapiens
ttattatttgagatggagtctcactctattgcccaggctggagtgcaatggcgcgatcttggctcactgcaacctccacctcccgggttcaagcgattctcttgcctcagcctcccgagtagctgggattacaggcatgtgccaccatgcctggctaatttttgtatttttagtagagatggggtttcaccatgttggccaggctggtcttgaactcctgacctcaggtgatccacccg

SEQ ID NO: 12966 - DNA, 237 bp, Homo sapiens
aaacattcttatacttccaagtattggtaagaaaagagtaatatggcatttttattaagcatctactagcttcaaggcataatgctactcctgtaaaaaaataaaaaattttatgaaacagacactaaggaagtgatatataaataaatcaaactaaagcaattgttagaaggtgactttaccacgaccccacaggtgaagcaccaagagaatgaagaaaaggaaaagagaaaatgg

SEQ ID NO: 12967 - DNA, 620 bp, Homo sapiens
tgtttgcctgggtatcagcagtggtggatgcagaacagcggtggctgtaggacagtggatcttggtgaaccgcaaatgctgctgcctgatcattcttctggaagttttgtctcagaggagtacccgaccgtgtgaggtgtcagtctgcccctactgggggatgcctcccagttagtctgctcgggggtcaaggacccacttgaggaggcagtctgcctgttctcagatctccagctttgtgctgggagaaccactactctcttcaaagctgtcagacagggacatttaagtctgtagaggttactgctgtctttttgtttgtctgtgccctgcccccagaggtggagcctacagaggcaggcaggcctccttgcgctgttgtgggctccacccagttcgagcttcccagctgctttgtttacctaatcaagcctgggcaatggccggcgcccctcccccagcctcgctgccaccttgctgtttcatctcagactgctgtgctagcaatcagcgagactccgtgggcgtaggatcctccgagccatgtgcgggatataatctcctggtgtgctgttttttaagcccgttggaaaagcacagtattagggttggagtgaccc

SEQ ID NO: 12968 - DNA, 516 bp, Homo sapiens
ttaaattctgtgcattttattatatacaaattattttgcaataagaattaatttttaaaaagcaataaaaattgctgctcggcgaaaacaaattatgaatatactatctaacacactttctggtgtgaaggaaatattctagatcttgttttgtgtggcagttacaaggatatctacaagtcaaaactcattaaactcaacttttaaattctgtgcattttattacatataaattattttgcaaaaataattaattaaaaaacaataaaaattactgttctgagaaaacaaattatgaatataccatctaactctacagagtacagaaataaaaaatatagtaatatctttgacctatttgaaagtcaacaaaagaaaagcaagaaagtgcctacaatatgattaagtgaatggcatttatatatatgtataatcatttaaatgtttacagtttaaaggaaaaaatagtgaggaaaagaatgctatggttttcaaatcctacggtttgtactaaag

SEQ ID NO: 12969 - DNA, 434 bp, Homo sapiens
cccctttcaggcaacatcacgtgcatggataatcaaagatcagatcctggtcaacatatgtaagcaagcctgtttaaaataaattcccccacattcccttgtacctactccttgccctctgcttcagggttatagaacagctgcctccagctattttcccctgaagccatgcagaaccatccaacctttcagaaggtttgcatcctttccctatagtttttccaccactctgactgatctcctacattacccttttgctggcatgccagttttctgggttctttctccctgagtggtcctggcgaccctgtctgactgtatgcaaacaaatacattgccatgaattaagaatattcatagatagtttacaaattttggagaaactaggcagagagagaaatatgactcaaattctatttgtaagggtatactca

SEQ ID NO: 12970 - DNA, 443 bp, Homo sapiens
aattgcctaataattggtctgttcaaatgtgtctgctatttgctctcagccaagccttaaagtacttacagaaccaagaaggaaccatctataccaatcctaagttaatttggactaaacaaggttttattaatagcaaataattgaaatccccaacttacaaggttttcaacaaaagtaaagtttgctaaaagttaacagtgtaacctgtattatcctaacttctaatcttgtggccttaggtagtctagtccacggacatgaaggaagttcgttttggagaagaatggttatcatctttagaaaaaaaaaaggtggggggaagaatgtatataaaaaatgttatatggtaaattcttgtcctaaaataaattaactggttgtttaaagaaagggatgtttgcaacaagtcagaaggttgaggcatgttgaagattgtgaaa

SEQ ID NO: 12971 - DNA, 1148 bp, Homo sapiens
aaccaatctgaggctaaagtggagttacaaagctgcccttctgtgcaaatgaagacttggcccacagtcagtgtgattggttggggacagcaaccaatcagaggctgatgtgaagttacaaagttacactcctatgcaaacgtctgattggttgcaaaaaccaaccagtcagaggtactttcaatttctcatctgccagcagaaaaggtaggggtttgcaaagggagtagcctctggtcattttgttacttaggcgtagaaagttagggttttcctttcaattttgttccaggaagtcagtgcaaaacggccttagattccccgcctccagaccctattctcctgcctcattcttagtcttaaactctgtattactgttatcttcttatatcttgtctttttaaataaatcatattttgggaatttaattgtaaaaatgtatactagtaaatgatcaactagagttcttgttctaaaaggagagtaaattatttgttccctttataaaaggtagtttagctgtacccagagttaaactacagagtttacaggtatacgtactcttcaagactgccctcatttctgacatcaactgcaagttgaagagcttcccgaaaccaacttcaggcttgataatttgctaagactcaaaaaactcactgaaagctattgtactcacagttacagtgtattatgggctaaagatacacattaaaatctcacaaaagaagagatgcatagggaagagtctagaagagtcccaaatgtgaagtgtccattttcctataaaatcaggacatgttacccttccagtatggatatgaaatatcaacatgtgtcccactgttcagagttttattggggctccattacctagtcatgattgattgattgattgattgcccaggtggttgaactcagtctccaggttgaccgatactgtatgacgcagatgccctaccccagatcacatggttagtctttctggcatggccagcgttcacccggtgactctcagttatggtcgctaagctactagataaaaggattaggcccttattcaaactggttgaatgcttgtcaactgtcaccagagtccatccacagaataaatagaaatataagaggcaaacagacaaaaaggaaaa

SEQ ID NO: 12972 - DNA, 278 bp, Homo sapiens
gcctgtaatcccagcactttgggaggccaaggcgggcagatcatgaggtcaggagatcgagaccatcctggctaacacagtgaaaccctgtctctactaaaaatacaaaaaaattagccgggcatggtggcaggcgcctgtagtcccagctactcgggaggctgatgcaggaaaatggcgtgaacccgggaggcagagcttgcagtgagccaagactgcaccactgcactccagcctgggcgacacagcgagactccgtctcaaaaaaaaaaaaaaaa

SEQ ID NO: 12973 - DNA, 459 bp, Homo sapiens
ctagaatttctgtatatttatagataatctcacctgagttcctgtaatgcagatcattattttcaactaataaaattcaccttatataaatacacagttggtgctcttctctagaaactctgctaacttttccagaaatgccttagagagaagaaatttcctgattttgtgagcttcttacttgaatatattctctttctttctcagcctataaacaaggcaagtttcctattgttacctgagattctaaggtagcaggaagaagtgtatttgtgtaaagaggtggttaatgccctgccactaataaaatgctctagatgtaattacagaggaggatgcactattttaaagaaaaattaaaacatacttttttttttctttttgagacagcatctcactctgttgaccaagctggagtgcagtggtggtcatagctccctgcagacttgaactcccagt

SEQ ID NO: 12974 - DNA, 259 bp, Homo sapiens
tttgcacaaccaaatttattgcaatattattaacacaagccaaaaggcagaaacaatccagatgtcccttgaccaatgaacagattaataacaagtggcacatacacaaagtcgaatattattcagtctttaaaaagacacattatatgataattctggagaagatcatgttaattgaaataagccaggaacaaagtgacagtctatgattccattcataatcaggtatcttaagtagataaactcataggaaaaaaaa

SEQ ID NO: 12975 - DNA, 459 bp, Homo sapiens
tccagttctccctcttggcaattgaatggtcggggggaactgaccttagtgaaaattgggtatctaaattagtggaatttgaacctttgactgtgcatgaagtgctgcaggggatttcagtcagcaaaggagatgccagggggatctcttagcatagatggtgcttgcttactgcttataagttaatgtgttgagatagaaatcaattgctacaagataaatgtaagctggaaaaagaaaacactactctgacttccagactggccctggctcaatttcaggcctatgtcttgactgatcaggctcaaagctaacagattattgatgagaaaaacagctgtgcaagtggtgtggtcagggtaaaactgaagaacgagtcagctggggcttggtgtgggtaaaaacccagttcctatctgaagaatgggaaattagcctttacaaatttcaagaacctgc

SEQ ID NO: 12976 - DNA, 182 bp, Homo sapiens
agttcggaggcagcggcgaggcgggccgcggcaagaagcagcgccacacccgggaacagcgctaggcggcggaggcgcatggcggcgaggtggggtggggacggccggaagggtcgcggctcggctgggactgcggaggtcgggcgcgcgaccacaaaccggctgcctgcgctggcgcgtct

SEQ ID NO: 12977 - DNA, 104 bp, Homo sapiens
atcccagcactttgggaggccgaggtgggtggatcacgaggtcaggagtttgagaccagcctgactaatatggtgaatccccgtctctactaaaaatacaaaaa

SEQ ID NO: 12978 - DNA, 94 bp, Homo sapiens
agagatggggtttcaccgtgttggtcaggctggtctcgaactcctgacctcaaatgatccacctgcctcggcctcccaaagtgctgggattaca

SEQ ID NO: 12979 - DNA, 251 bp, Homo sapiens
tttttaaaatacctcctcaaatgttgctcacatttgtatttgtttcttagttgttggtgtattctaattaatttataggggctcattacatagtctgtattattcctttctcattgtatgtgttgaaaatttctttccccactccatgtctttccttttcactctcttatagtgcttttagatgaaaagagtgtgtaattttaacatactagagttatcaatcttttttttttttttttgagatgaagtct

SEQ ID NO: 12980 - DNA, 313 bp, Homo sapiens
gtagtataatttgaagttgagtaatctgatgcctccagatttgttcctgttgcttagtattgctttggttgtgtgggttcttttttggttccatatgaactttagaattttttttttctagttctgtgaagaatgatgatggtatttcaatgggtattacattgaatctgcagtttgcttttggcagtatggtcattttcacaatattaattctacctatccacctgcatgggatgtgtttccatttgtttgcatcatcccatctatgattttttttcagcagtgttttgtagttttccttgtacagatcttt

SEQ ID NO: 12981 - DNA, 251 bp, Homo sapiens; identical to SEQ ID NO: 12979

SEQ ID NO: 12982 - DNA, 284 bp, Homo sapiens
atcattttagattgatcatcttggctacattaggtatctgtatttagataataactttatatttaggtagacaattttaagacaaaaagtagaaattaacaaagagaatttttattaaattgttggaatttaccatttggaaatccatacacaggttcaattcccaaacacctatatattgcctatattttcatcattttgatgtcatataacagactgttgattagtattattcacttgcaactactttaaccactgaaagtattcattttcattattaatac

SEQ ID NO: 12983 - DNA, 186 bp, Homo sapiens
gctttaccagcagtagtaaatttatagaagagaaacagaaatgctttgctgttaattatgcttaaataagaatagaagtaaaggagagtattacctgcaaatcaccagagcagctttcccccgtataagcagttcctaaagtgaatgaaagcagctctccttatgtgtctgcctactttattcttc

SEQ ID NO: 12984 - DNA, 722 bp, Homo sapiens
aaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacc

SEQ ID NO: 12985 - DNA, 295 bp, Homo sapiens
gttttctttttttttaaaaaatttattattattatactttaagttttagggtacattgcacaatgtgcaggtttgttacatatgtatacatgtgccatgttggtgtgctgcacccattaactcgtcatttagcattaggtatatctcctaatgctatccctctgccccccgtcccaccccacaacagtccctggagtgtgatgttccccttcctgtgtccatgtgttctcattgttcaattcccacctatgagtgagaacatgcggtgtttggttttttgtcctggcgatagttt

SEQ ID NO: 12986 - DNA, 237 bp, Homo sapiens
tggatcacctgaggtcaggagttcaagaccaacctggccaacatggtgaaacgctgtctctgctaaaaatacaaaaattagctgggcatggtggtgggcacctgtaatcccagctactcgggaggctgaggcaggagaatcgcttgaatccaggaggcagaggttgcagtgagccaagactgcactgttgcactccaacctgggcaacaagagcaaaactccgtctcaaaaaaaaaa

SEQ ID NO: 12987 - DNA, 116 bp, Homo sapiens
attctcctacctcagcctcccaagtagctaggactacaggcgcccgccaccacgtccggttaattttttgtagttttagtagagacggggtttcaccgtgttagccaggatggtct

SEQ ID NO: 12988 - DNA, 1469 bp, Homo sapiens
tattagtgatgatagaaccagatataaaattgttcagtgatggagaaaagaaacgataaatactttccaaggttatattgttaaattatcttaaattatcaaggtgtaagatgtaatgatcccaagagtttttatagaatcctaaaaaataacgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaa

SEQ ID NO: 12989 - DNA, 225 bp, Homo sapiens
gggtggatcacttgaggtcaggaattcaagaccagcctggccaacatggtgaaaccccctctctattaaaaacataaaaattagccaggcatggtggtgtgcacctgtaatcccagctattcaggaggctgaggcacaaaaatcacttgaacccaggaggtagagattgcagtgaaccaaggtcgcaccactgccctccagactgcggtagagtgagattctgtt

SEQ ID NO: 12990 - DNA, 487 bp, Homo sapiens
gggtatagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagtaatatatcctt

SEQ ID NO: 12991 - DNA, 407 bp, Homo sapiens
tggaatgtggttactccaatagaaatgagaggaatcttttatacttacttccatgttttaccatttctgatgctcttcatttctttgtgtaaaccaagcttgtccaaccatggcccatgggccacatgagggccaggatggctttgaatgtggcccaacacaaattcataaactttcctaaaacattatgggattttttgcgattttttgaagctcattagctatccttagggttagcatattttatgtgtggcccaagacaattctatctccaatgtggcccagggaagccaaaagattggacacccctggtgtagacccgaatttttgtctgctctcacattccatgtaatagagagtaagattccattttttatgtttgacctttgatagctttcaaacctcat

SEQ ID NO: 12992 - DNA, 282 bp, Homo sapiens
cacgcttgtaatcccagcactttgggaggccgaggagggcagatcatgaggtcagtagatcgggaccatcctggctaacacagtgaaaccccatttctactaaaaatacaaaaaattagtcgggcgtggtggcgggcacctgcagtcccagctactcgggaggctgaggcaggagaatggcgtgaacctgggaggtggagcttgcagtgagccgagatcgtgccactcactccagcctgggcgacagagcgagactccatctcaaaataaataaataaataa

SEQ ID NO: 12993 - DNA, 303 bp, Homo sapiens
gaggcagtctgcctgttctcagatctccagctgcgtgctgggagaaccactactctcttcaaagctgtcagacagggacattttcgtctgcagaggttactgctgccttttgtttgtctgtgccctgcccccagaggtggagtctacagaggcaggcaggcctccttgagctgtggtgggctccacccagttcgagcttcctggctgctttgtttacctactcaagcctgggcaatagcaggtgcccctcccccagcattgctcccaccttgcagtttgatctcagactgctgtgctagcaat

SEQ ID NO: 12994 - DNA, 280 bp, Homo sapiens
gcttaacttcagatcctcaagaaagttagtgatctggagaaagggtcttgttctgggtaggctgggccctcttgtctccagtatatgatgttctgtagggatggacaggaggttatattctgcacctggcatctgccatcccatgcgttgggtctttaaagaatgacagaacaattggcttcaggttctttggatatgctggtttggggccctgaagcccagaattgcaatgtcatacagcagccagattaggaagctcacaagcaaggcatcactagcc

SEQ ID NO: 12995 - DNA, 2312 bp, Homo sapiens
ttttttttttaattcctatctagtttctttcaggaaatttctccatgtggaaatttctcctgtttaatgatgtccacagaccagccttctaaagagaattcttattttgcagtaggctcactacagatttgatgatggaattatctgccagatgcccagttctccctttgaggatacacagatagactccagtgtcattagactatcttcccctgaaatgcttttactatggctcctgcacaacttcagggtgtgccacctaccagccatccagacaaaaagtcatgctgaccacccaggctgcagcagaaggaggagatgagctctgggcaagtatgaaaagatattgatggcaagaaaactccttttttccccaaaaatatgaaggttaatgataattattcttctcatcaaaatgtttttgtctccctccttccaggtaaaagtgctaatgcttttagaacttacaaaatgaaactggccataacctgagccttcttttgcactcatctggacttatggtcttcatctccaaatgagacaaacaggagagaatggaacttctgagccctaggggcagcattcacttgaaagtcaattacgtccaaagtaagacactcatgataaggacacttctgaaaaacagagtgaggtgtctgctttcatgggagtaaacctattacttccacttacaataataattctcttaacatctccttaatgctccctgataaatctcagctcctcctcaaccagctctaaatgagaatgacaaggaaagttgtatgaggccaagcagaatgagatctgtagctgcttaagagtggctgataattaacccttctctctcttccccaatcccagtgggtccatgacttttggacaataaagcacccaacctgtgacagcactaagtgattcctgtgccacaggcgggaagcctctcagtgaggctgtgcacttaacagtcatcccaatgacagggaggacagtcttatacacaggaagtttataatgaactgaatttgacaatggcagcctgttcatgtgcagaaactaagatcagtgcctggggacaggcagtcaacttttaaatattaaacagcatataaatatgtatagccttgacctgaacacttgagttatacgttctgaataattatcatttctgaaagactaagggatagatttaccaaattaaaatacagaatctataggatcatgatgttctgcatttatagcattacacgatcaaagccccatctggataaaaggcaaaggcaactttaaaaaagtccttagagattagatccttgaatctcatctgaagtccactggtttcattttcactatatgttacttcatataaatcgggtaaaaaattatagtcatgatcataagtagggtcttgagatgtggcaatcaaagcctaaagattaatacttaacttcagttttcaaactaagtcccacattatccaaactgaagcaatgagtcagagaaatttcaaaggttaaatgctactgactttaaaaaacataaaaccatttgtaccacatcattctaatctcataaatttaatgctctataaaagtaacagagatacgtttagcaatttgggaaaaccaacgagagatgtcatttgcattgcttttgagatgaaacgtgatgtgataatttaccaagactgatcattataaaataagtgagcaacaagatgagttgagctggaaaggaaagggaggagtgggtttttagatcactaactctgtgactttatggtccagagccacatcaaccatgtgagtcaaaaaactttcaccatttcaaaatgcctggcctgggaattgggggcaatttatttctattggtgtaattacctggatgtgattttaccagcaccagcaagagaataagatccagttttaggaaataatatggatttgttcatccactcccaacacagcttgcttgctcatcctaaaatgatactattgctaagtaatgtctaccactatcgacctattctttagctaaattactaattagtttagcatgtctggttattaaactgcaatggtgagttaaactgtaatgctttcaaaactaaagactggctagtggtcaggtaagctatacctcttgcttctctggtcgagtccacgaagcctggagaaaacaagatataaaacacaacaagaaagcagtaaaattttacaacatgttgctttagagaatgtatcacactgcattccgtgcacatgcagcttttctttaattcagaactttttccaaggcccactttcaatggt

SEQ ID NO: 12996 - DNA, 187 bp, Homo sapiens
ccaaaaattgtatttagatattaattttataagtactttttctacatctattgaatggtgtgtagtttttcccctttaaccttttgatgtggtcaattactttaatagatgttcaacttataattttaggggtaaacccagcttgtttatggtatattatttgttttatatgatgtgagattttgtt

SEQ ID NO: 12997 - DNA, 558 bp, Homo sapiens
ggcgccggattctagtgtcttaactgtgaccaccctaaacattttacaaacaattgtcttgtttgaatcctcttcaaaaaatgatttataatcaactataagactttaataaatactatcaaatacaggtttctaataacagaaaaacatacggaactcataaaaaacttaaaatatttacaaatatcaaacagaaccaaagttaacaaaataaactgaactaataaaaaactgaaagaatgtttttaacttttacttagaaagttaaaacttttaacaactaagcaaaacatactcctataaacaaaatttagaacatatttatttctctttgcctggttcctctagaattcagaaactgattatgaatatttttaacttacaacaatatacttatttacatcaatacaacaaaatccattttattttacaacaggacacaattttaaaaactggttattttacaagacttttacttgaaagatgtatttccctttaaaaaatcaaactggattcacaaaaccaataaaagccctttaaaacactggcctcatacct

SEQ ID NO: 12998 - DNA, 317 bp, Homo sapiens
gaattttcagcctttctgctctggtttctccccatctttgtggttttatctacctttggtctttgatgttggtgacctatggatggggttttggtgtggatgtcctttttgttgatgctgatgcttcttctgtttgttagttttccttctaacagtcaggcccctcagctgcaggtctgttggagtttgctggaggtccactccagaccctgtttgcctgggtatcaccagcggaggctgcagaacagcaaatattgcagaatggcaaatgtttctgcctgatccttcctctggaagcttcatctcagaggggcacc

SEQ ID NO: 12999 - DNA, 103 bp, Homo sapiens
tttttgtatttttagtagagacggggtttcaccatgttggtcaggctggtcttgaactcctgaccttgtgatccacctgcctcggcctcccaaagtgctggga

SEQ ID NO: 13000 - DNA, 443 bp, Homo sapiens
ctccacccctgagcattttgcattctaaggacctttgcacaggcttctattcattctttagtggaagtttgtgtgtttgtttcaagaagctactttttagagcagttttaggtttacagaaaaattgagcagaaagtacagagagttcccatatactaccccaccccaccctaccccaccactagtttcctttattattagtatcttgcattgggatggcacattagttgcaattgatgagccaatgtggatgcattcttattaactaaagtccatagtttacatgagggttctctctttgtgttgtacattctgtgggttttgcctaatatgtcatgtcatgtatccaccattatagtgtcatacagaatagtttcactgctctaaaagtgccctctatcccacctattcatccctcccttcccctccaaatccctagaaac

SEQ ID NO: 13001 - DNA, 474 bp, Homo sapiens
tttgatgatggtgatgtacagatggggttttggtgtggacgtcctttctgtttgttagttttccttctaacagtgaggaccctcagctgcaggtctgttggagtttgctggaggtccactccagaccctgtttgcctgggtatcaccagcagaggctgcagagcagcaaatattgcaaaacggcaaatgttgctgcctgatccttcctctggaagctttgtctcagaggggcatctggctgtatgaggtgtcagtcggcccctactgggaggtgtctcccagttaggctactcaggggtcagggacccacttcaggaggcagtctgtccattctcagatctcaaactctgtgctgggagaagcactgctctcttcaaatctgtcagacagggacgtttaagtgtacacaagtttctgctgccttttattcagctatgccctacccccagaggtggagtctacataggcaggcag

SEQ ID NO: 13002 - DNA, 396 bp, Homo sapiens
gtaagatgatctacattgttgctgtatccaggcctttactgttgtaagaaatgttggagtgttagttgagggaaaaagtatgtattggtaaatataaactctactcatactaatgagagtttttgatatggtctactttatgatggcttcaagaaaaggatgtaatctagcatataacccattatttttaagagccctgggtaaattttagcctttgtcatatataaacttgttatatattagtgtatgtaacttcggaggtactaattctaacatagaattctagtattttagagtgtacaatttctcccttagatactttatataaacagtttttcaaaatcctaatttttaatccatctatgctgcaacaataaaaaaactttgtaaatatta

SEQ ID NO: 13003 - DNA, 434 bp, Homo sapiens; identical to SEQ ID NO: 12969

SEQ ID NO: 13004 - DNA, 443 bp, Homo sapiens; identical to SEQ ID NO: 12970

SEQ ID NO: 13005 - DNA, 1106 bp, Homo sapiens; identical to SEQ ID NO: 7963

SEQ ID NO: 13006 - DNA, 1519 bp, Homo sapiens
tcttgggttgttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttagcaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctctcccctttttctattccacaaaaccgccattgtcatcatggcccgttctcaatgagctgttgggtacacctcccagatggggtggtggccgggcagaggggctcctcacttccctgtaggggcggccgggcagaggcacccctcacctcccggatggggtggctggccgggcggggggctgacccctccacctccctcccggacagggtggctgccgggcggagacgctcctcacttcccagacggggcggctgccgggcggagggtctcctcacttctcagacggggcggccgagcagaggcgctcctcacatcccagacggggcggcggggcagaggcgctccccacatctcagacgatgggcggccgggcagagacgctcctcacttcctagatgggatggcggccgggaagaggcgctcctcactttccagactgggcagccaggcagaggggctcctcacatcccagacgatgggcggccgggcagagacgctcacttcctagacaggatggcggccgggcagagacactcctcactttccagactgggcagccaggcagaggggctcctcatatcccagacgatgggcggccaggcagagacgctcctcacttcccagacggggtggcggctgggcagaggctgcaatcttggcactttgggaggccaaggcaggcggctgggaggtggaggttgtagcgagccgagatcatgccactgcaccccagcctgggcaccattgagcactgagtgaacgagactccgtctgcaatcccagcacctcgggaggccgaggctggtggatcactcgcggtcaggagctggagaccagcccggccaacatagcgaaaccccgtctccaccaaaaaaatacgaaaaacagtcaggcgtggcggtgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggaggggga

SEQ ID NO: 13007 - DNA, 374 bp, Homo sapiens
ttgtgttttctagtgtcactttttattttgacttgcatatgggaaattacacttaaactttcatttgtcccagcacagaggtatatctgcatgagagtcctagtcactacttacatttataatataactctgggttgcaatatttataggtttatttatgtcactattttctattttaatgtaattgttgtttgaccccaccacccaactccccacacataagcatcctccacaaggcaaggattttttttaatttcattcaaagttataaccaaggtttctaaaacagtgcctgccactgagtatttattgaataaataaatgaattacaaactctgtagcttaaaaccacagaacatttagggtattgacaa

SEQ ID NO: 13008 - DNA, 381 bp, Homo sapiens
ccagagagtgttggggaaacgaaggtaaaaaataaaaacatcctgttgtgaaactcatagaaaggtgaggtggttggttaagtacttatggaatttctatagctcttttccagtcctgaactatatgttactaggaacagagaatacaggtttacaagtgtaccgttcaggtcacagaactcctgtaatcagaaaatgtcataataaagcaaactgaatcatgtcaaagccagtagaggaggttgataactaagagtgagtcttgggtaagcttttttctaagttaagaatatttaatcactctccaatttgtggtatataaatctggattactataagtgtacttgtgcatatattaatatattcaatcttaagaataac

SEQ ID NO: 13009 - DNA, 553 bp, Homo sapiens
tcatgcatagatactcttaacaaatgaatacttagcattgcttttttcaagcaacaaatatattactttagctttctcagagtaagattacaaaattgtggaacttactgggttttgtaggaaaagctagtttctaattaaactcttaatctatttttagtgctgagtacatattgagaaggtagaatatttccagtggcctggttagaaatacttttcattgcacaaccaacatgaaaggatgacttatttccatgccagctgtcctcagttttcctgaccttaatggaacatattagatccagctgctggaatatttactctaatggaataaagcagttggattctttccttgcctattttccaaagaggacagtgttgaccaaaatatgtacttgttggtagcactagaagatcttcatgatagatacagttgacaacttttaaaataattgtctgtcccaatggggaaaaatgtatataatacacagaacactaggttaatatccagaatgcagacatattttcatatattcttacatctttcttatcc

SEQ ID NO: 13010 - DNA, 360 bp, Homo sapiens
tagctggtattacaggcacctgccaccatgcccagctaatttttgtatttttagtagagatggggtttcaccatgttggtcaggctggtctcgaactcctgacctcgtgatctgcccgcctcagcctcccaaagtgctgggattacaggtgtgagccactgtgcccggcctgcgctgtgattcttctatgcagctccaaacatacttctctcagtggttctcaggaaatactttttgcagacaatgactgtgagtccacagtaacagattcatagaaatggcttatgtaggccaggcgcggtggctcacgcctataatcccagcactttgagaagccgaggcgggggctgatcacctgag

SEQ ID NO: 13011 - DNA, 1785 bp, Homo sapiens
tttatttttgcttttattgagacagggtctcaatctgtcactcaggccagagtgcagtggtgtgatcacagctccctgcagcctcaacctcccaagctcaaacaatcctcccacctcagtctccagagtagctgggactacaggtgcacaacaccatacccaggtaatttttttggagataatgtctcactgttattcccaggctggtgtaaaaactcctgagctcaggcgatcctcccgtctcggcctcccaaagtgctggggatacaggtgtgagccaccatgcctggcttatgtttttttcaaaactagaaaatctccagatgttaaaaactaggcacatatttttatataacaatgaattgaaagatatttttaactgaaggataataaagagaggcatatcaaaacataagagctgcagctaaagcagaactcaagggaaaatatatcgtcctaaaatctatgtatacaaaaaagaaaacaagctgaaggatcagtgatctaaacttccatctcaagaagctgaatacgtaaatctacccaaagaaatcagaaagcatttctatgtttccaatgctaaagagaagagcaaaacccaattaaatagaaaaaaatcaatgaagctaaagcttagttctttgaaaaagtaatacaattgttaaagccctcaagcaaggttaatccatgaaaaaagagagaaaatataagctgccagtaccagcaacaagtatattttaactgtatactacatatataaaacactgagcatgaagaggaggaggaagacgggggaagaaaaacatgtgttttggagccatccagaagaactatattccagattccattctagtcaatttaatccaatatgcatttgttggaagagaatataaactactattagtttggtatgaaaggcctagaaggaaaaagcacatgaattttggagttggacagagttgagttcaaattcagtctctagcttgatactaaatgtaggacttacggtaaattattaggttggttcaaaaataattgtggttttgccattcctttcggtggcaaaacttgcaattacttttgcaccaacttaaatatataacctctctgagctcccattttctcatctaaaaaatgaaataataccaacctcacagcactgttggaagggttggggtaaagcaccaagtacgtgggtagcttatatcctacagaataattttcaccaacatgacccatgaccatgaagtttatggtttgactatctgtaggaagggtacaaaaatacatcatgcaacaaggtcattcatttggaaatgtaatgctttctgaaaaacttgagcattcacttttcttcacttgcctgttctaataagagaggtttggtgtggtgatttttcaatagaaaggatgttaccaatatataaataacataaaaggatcacatgagaattaaagtgaagtaacttaacatacaattttcattctaatcttatacaataatttttcttgactattgatagatcacaataaaggtatgctgatgatataagttattttaagactttggggaaaaaggcttccgtctctggcattgaccttattgtggaggaccctccaaaatcttcagctctgcaccagcaggtatgctgagtcatgtatgatgacataaaccacaaggagtcaaggagctaaaacaaccacagcgactggctcagatctcagatgtgcaagatgaatcctcaggatttttcacacactgaagaaacttgtcaggtctatgac

SEQ ID NO: 13012 - DNA, 120 bp, Homo sapiens
gtcttgctctcttgcccaggctggagtgcagtggcaccatctcagctcactgcaagctccgcctcctgggttcaagcaattctctgcctcagcctccccagtagctgggactacaggcac

SEQ ID NO: 13013 - DNA, 426 bp, Homo sapiens
acctgtgaatgactaactaatctaatacagatgaaagcccaatcctgatgaactgtttccagaaaagtttctcatgggagaaatgttatcaaaccatttgcaatctcttggagttgctgggaaaaataacaacagcaacaggtaagtcaggtaaactgatcacaattctctatctttttctagtctgtaaaaaaattagtcttacaataagaacaaacatgattgagaaaaataatcaaattattcagtatattagtgtgtttaagtggtgtatatttaaaaagaaaatagatgtttaaacttaagctatagactcatcagaatttcaagtaaatcatatgtttttgaccttgccctttccattaaccacagaagaatgttccgtgcataattcagtggtggcttcttctcatccttcagatcctg

SEQ ID NO: 13014 - DNA, 349 bp, Homo sapiens
aaatgacagcttactcataggatctttattattattccaaattagcaagcattaatatattttcagtgcaggtaaatcaagaacaatgttctctttgatgctttttatgaatggcacaagattagcatgttacctaagagagcttttctcaatgctagatggctgcaaattgtttatagataaagtagcaggagaaaaattcaacaaaatcctgtttctcagtgggtcattatttttttagttatgcttttaggcatgagctaatctctgattacctcaacactgacaataaaactgatttataaataatcacaatggaaccattcagtattggagcttgacaagcctt

SEQ ID NO: 13015 - DNA, 783 bp, Homo sapiens
tcacacctgtatttccagcactttgggaggccgaggtgggtagatcacttgaggtcaggagttcgagaccaacctggccaacatggtgaaaccccatctctactaaaactacaaaaaaaaattagccagacattgtggcaagcacctgtaatcccagctactcgggaggctgaggcatgagaatcacttgaacccaggaggtggaagttgcagtgaacggagattgcgtcactgcactccagcctgcacaacagaacgagacttcacctcaaaaaaaaaaagaaaaagtgtgtttagaagatagcacacggtgtggccaggccaccatttgataagattagtatggatatgagaaagctatgtgctatttatcaagacaatgggagaatgaccccaaagatattatggacatcttggtacaaggggagggggcaaccatgcccatcaaaaggccagagtgctagggtcttggggacagatgaattttgaggaggggcccagggtgcccatgggacctgtttgctcactgctgagggccaccttgggtctctgcaccctgcactctggcacagtgctccttggctaccccagctctgattcaagcaggcccaggtccaggtagggccactactctggagggtgcaagcagtgagccttggcacatccatgtggtgcttaattctgcaggtgtgcagagtacaagagcagtggaggctggcttccttcacctagatttcaaagaatgcctcagtgggcccaggcagagaactgctgcaaggacaa

SEQ ID NO: 13016 - DNA, 300 bp, Homo sapiens
gaggcagtctgcctgttctcagatctcaagctgcgtgctgggagaaccactactctcttcaaagctgtcagacagggacatttaagtctgcagaggttattgctgtcttttgtttgtctgtgccctgcccgcagaggtggagcctacagagacaggcaggcctccttgagctgtggtgggctccacccagttcgaggttccaggctgctttgtttacctactcaagcctgagcaatggcgggtgcccctcccccagcctcgctgcgccttgcagtttgatctcagactgttgtgctagca

SEQ ID NO: 13017 - DNA, 370 bp, Homo sapiens
ggatctgcgttcctttggagggggagaggcactctgatttttacaattttccacttttctgctctgttttttcaccatctttgtggttttatctaccgttggtctttgatgatggtgacatacagatggggttttggtgtggatgtcctttctgtttgtttgttttccttctagcagtcaggaccctcagctgcagttctgttggagtttgctggaggtccactccagaccctgtttgcctgggtatcagctgtggaggctgcagaacagcggatattgctgaacagcaaatgttgctgcctgatcattcctctggaagcttcatctcagaggggtacctggccatgtgaggtgtcagtctgcccatact

SEQ ID NO: 13018 - DNA, 494 bp, Homo sapiens
tatatgcacatatttatacatatgtatacatacacatacatagctaatgttaggtgtaccatgttaacatacataaacataaatacatttacatcaaataagtattcatacatctctgttttctaaagagatgttttaagaatggatcttgttttacccaagttttttttcagtatgtgtgcagaacatcatatgttttttcaatttatttatttgtgtatttgaaacagtgtcttgctgtctcacccagagtggagtgcaggcgcaatcacagctcactgtagcctccaccccctgagctccagtgatcatcccacctcagcctcctgagcagctgagactaccggtgccctccaccacacctggctaattgtattttttttatagagaagggggtttcgctatgttgcccaagttggtctcaaatcctgggctcaagccatccatccgcttcggattacaggcattagccaccatgcccagccttatttttt

SEQ ID NO: 13019 - DNA, 92 bp, Homo sapiens
gggaggccgaggcaggcagatcacgaggtcaggagattgagaccatcctggctaacacagtgaaaccccgtctctactaaaaaatacaaaaa

SEQ ID NO: 13020 - DNA, 693 bp, Homo sapiens
cttacccaatcattctgactccaaaacttatactcttagctaccatacagttagaactaaacaaaacactcaatgaaaaaaattttttcaaggtaaaacttaaaaaaattttactttgcaaggtaaaacttaacaaaacttaaaaaagattttaaaaacttaaacttaaaaaatttaaaattaaagaaactttaaaaacttaaaaaaatttacttttcaaggtaaaactttaaaaatttttatttctgtagtgccagaggtagaatattttttcaaagtactactgatgctggggaaataattaaaactaaaatctcctgtcaatccagtgaattctctttacaaacgtaggaaaaaaaagaaacagttttattactgaattcaatcagattcaatcagattgtgatgcacattacaggcaatctgttagagatattgcaaagacagaaagaaatgtcacccttttgtatagcaaggcagatacaatccattatatacatgttaattatctgtattaaaggaaaaataaaaacttctaatgtctttttgataagtaagaggttacaacttggggccaggagccttgacgaaattccaacagagacagggaaacaaggtaccatcttccgagatgttcacatttcaaagaaatgattccaaagcccccaagaaagacattgctgagattcaaaa

SEQ ID NO: 13021 - DNA, 8472 bp, Homo sapiens
cctggatggaatttttaatttatttatcatgtttgtaagttacagacatttatgttttcagcaacagtttataatagttacatctcatacttcaactattagaacagagagaacattaaagtacaaagaaagacttcaaaaatgaggttactgtgatgtatcataaaaggagttaaaattcaaaatatcaaagacctcacctatcggactaaacataaatcttaaaacctcctatggtcctctgagcctaaaattacaaaacttagcaactgcttaaaccaaggaattaacggttctgtgttttcaaggtaagaaaacaaaaaatgctttggtaaactacctttaatactagtttaaatgtttctgccttgtttgtatctctcttgaaagactgtatataagtacaggcacagcatatatttgagaaaacatctcacaaatttcatttactataggtttctcaataatctttacatttaatcaatgagaaaagtgattcagtctcttgaattttaagttaaaaaaattaaaaagtatttccagggactcttaaagctctctcccaaagtataaaatattatgtactttcaaaatcttaagcattcacgttctttctgagaccaacgcaggatacaaacttactctcaacatagatgcttatgtgcttttgggcacacatagtcttagaacagtggtcaaacagctcacaggaccctgtactcctcttcatcctggactgtgacggtggccacagccagaccagccccctcccatctgccttccaggtcagattccctggcatttattaagctgtcactcttcaatgggttcttccttgggggactcaagctcattcaataagtctttgccagctgctccggcttttgaagcaaagagaactgctccctgcttaaaaccgaggttcttcaaactccgggcataatctgcatatatagcagtgatgagtttctgtaaaccatagttaaggaaaagaagagtaaaaagggctgtgatgagactcttcacaggctcccagaagcaggaagggtgagtcgcgtctgctctgctggctgctcggaagggacctggtgtccacagcgggcagcacaggatgaacacaggagacttttcgcgggcagagggtgattcccggccatagtaggccatgtctcagtctgtaccatcattacctttcgtaccagctgagtccaaagcttctccttccagaagacccaaccaacatcctcccataacctacactcaactgaagattggaagatgaatgataagagaggagaaacttaacctgcatatcctcattccatttgaaagtctgagaggctggcagtttgggggcagatatttatttctgaatgttccctatatctggttgttgggtttttagaaagccctgtcctattggtttttttttatttatttttatttttttaaacagcctattgggtactctgtgctgatgctttgatcctcaaaatgcatacactgaaccagtcaccttcccagtgactaggtacatgatcttgagtaggctcagccttcagtttaattttaaaaaactttcagtgcagggctgggtggctcatgcctgtaatctcagcactttgggaggccaaggtgagaggactgcttgaactaggagttcaagaccagcctgggcaacatagtgagacccgggttactaccaaaaaaaaaaaaaagccaggcacaatggtgtggacctatggtcccagctactggggaggatgaggtgggaggactgcttgagcccaggaagtcaaggctgtagtgagccatgatcgtgccactcactccagtctgggcagaagagtgagaccttacctcaaaaaaaggaaaaaaaaaatttttagtttagttttaattctctgttaaaaaaaaaaaaaaattataaacacacacagagaaagagggagaaagagagagagaaccaagtacctgccatgtagaaatgagagcaaatgtaagaatttgaagcaaagtgcagtgagcagcagcaggaccatgcaagcactggcccagtttcattcttttctggtcctgggagttgcattctcaagttcattcttttcaaagaaaccaatgttgctcaagtgccatttagaagaaataaaatgttctggctgatgggtggattatagtggctggcctgagcaacacctctctttaagtgctgtattttgtcccatatcatattgtcactagaggtgatcgtgagacttttttagttattccagtatattttttctagataaatatataaaatttattccatggaatgtctggtcttgaaaaagtactatttcaaagtaccaggtccttctacctgtttcccaaatcattccttcatcttctttttaagttcagacaagacttgggggccctgtcctctatagtccttcctgcctccctccatcctagtcaaagctgacacccatggtgcagccaccttcttatctgattctttgtcctctaatttctccctctttcctggctttggtgaatcagaaaatcagaacatggatctttcacaatataatatagttcctgtccaggcagcacaactaagggaaattccaaaacccatgcatgtcactttcttcctcgtcactacaaacaaccttgcaaaggatatctgtgtcctcagtgacttcaaatgctccatacttgaggcaagcttccacaaataaggctgctctatcaaagtatctcatgctgctcaacagaacaaaacaagagttatgctttgtgatttacatcactggtgggcagcagcatcgaagggtataaagacatttacacattttccctggaaacctgcatactgcattaagatacaagcacttttctaagccctagtttgttgaaaaaaggagggaagaatactcacatctccaaacacaagctttttaaaattaatactttaaaaaattgtgaaatagtttaaatacacaaaaatctacagagatatgacaagtgcccatgtacccctgtccagagttgacaagtaatcttttgtcatatttccgtaatctacctcccttagttttgaataaatgaaatgctccacaattagtgatggttgttcctcttccagattttcagacgggatgtctccacctcaccatgccttctgtcgcctctccccctgctctctgggcctcctctcagttgctctagtcaaagctgaatggaccccaattctctgaagacttttaaattcccttttactaggtgcctgttaagtctgatcagcatattagtaggaaactagcatagctcctagaccgaatgaagatgtaatgaatacggacagttccattctcctttgggttttttgacaaacctgaaatgtatacttctcctttcactttacacatcgagtaccatgacctgctagaaccgcgagagaacatgaagtgactgctcacgggcaggcctgagcagcccatgtgaactctcggtttacctgtgaagcgtctctgccacgctaaaaaagcagcccagagagaggagaaccaggagagcctttgatttctgattgacttgtggagaacaaaggtggtcaacccaccgccttaaaacatcggcacactcctcaggattcaaacggacctgagaaagacgcctgtgttaacaacaaaaacatcctgcactctataaagaaaaaataataattcagttaaagtgagatctgtttctatgaaatacaggctaggctctgcttgactagcacactgccctgaagctgctgcatactctgaataatgataacggtctgtgcctacgggacccagggcctggctatacctctggactgtagtttcggctcagactctgggagaaagaggaggcagctgcttttacttaattgctaccaatgcaagatccatttttaaataagtaatgcaatttacactcataaagaataggaaaaggataaaggttccaagacagtatttgcaaagcagctttgcaggccaaaaaatgtttctaagtcataagtccaaagttcaggactgagctttctatcccgaatgttgagggcacctattgaaacttggaaccacctacttttgccagccatgcagcccgattccactcgccgtatgtctgcaggtagcggcaggcgtctgcagccttatctatcaggcagagcaactgaacgccctctgaaagacaaaagcgcatccccttaagtgacactgcagctccttctttgagaagtcattaaaaagttaaatccccatttgaccttatctagtcgtgcccattttatacctactgaagacattcttgatttaaattctgaaacataatattaagagttttactgttattactcaagtaaccagggtaggaagcacaatacagtctggagaataagtagggagagcatagttctctcacaggttttattgttctgatttgcctaggattgttggatttatgcctattatctcagcaattattaacagtgccccctttcactctgaaaagtgtaaacaattaattctggtttagacaattatattcatctgatttataggtagcaataatttttctatttttcttcagcatatgtaaaagagaaagaaatgtccctactaatcagatactttgctgggaacaaggtctcatttttcagagagatgacaaacatatcaagtgtgccttacctgccaatttgccattggcaatcatattcgttgccaccaacttaatggtgctctgagaggggcctgacgaggtgacagtagtgactaaacaggctttcagtgaatcacagtaataatgctggttatctgcacttgtttccaacagcaactgcacagctctgtctgtctagtaagagaaacggtttttctaattatgagaacattttcctccaacataactttttaaaattcataaggtagaaaactaaaggaaaacactcattttcaaaaaatgcaattgaatattttgtttacaaatacaaacattaaacagaggtgctacactacttttttgagacaaacataaagccagaggctggtgtatctaggtgctcgagtaattgcctattttagctttgtaccagtcaattcagacacaaaaacaaaacaaaacaaatagctgggctccactgggcattatggaagtctaaattacaagctggttaaccatatgttttttctcatgaggtttattggtattattttgaaagaaagcctaaactgtctacagggaaggaggtacatacaaggggaaaatattatgaaatatatacatacagatatattgctctgaaatacgaattaactagcaatttaatgaagcatgtagagttataaaaactgacatacttgacccaagagcagtagctggtctgtacatttccttgtatgatcataagttgaccgtttcacttcctgtagattaaccctttctagctgaaatttctagaattggaaaaaaaagaaaaattaagcctggattataagagtttggaattatttaaattttactgtacttaataagatcattttaataaactactttgacttttcaggttactagataatcaactttacagcaccccaaacatttaataagaatttgaacagcaaaaatgttgatagatattatcacttggatgcatacctgcctgcctacagaaactgacacttaagtagagccggatgaaaaacctatgtgcactgaaggattctgcaggaggttaaagaaattatcatgtgaacagcaaattcaaaccaagtgtataaagtatttgttatttataggaaattaatgacagaattaaaatgaagccaagttaaaaatgtaagacaaattaaacaagcctgtttaataataaaattttaatgtttagtaaacaacgcagtaactgtctatgagcttttcaaatcttgatcaggctttttttttaatgcaaatgtaccgagggcttctttcttttctttctttttttttttttggagacagagtcttgctctgttgcccaggctggaatgcagtggcgtgatctcagctcactgcaacctccgcctcctgggttcaagtgattctcctccctcagcctcctgagtagctgggactacaggcacgtgccaccacacccagctaattttcaagggcttatttctattactgaacagtaacttagtttgaaagtttcccaagtttaagatattgacaaagatataagtaatcaagatgacagctctaaaggttttgctgtgtgaagcagactacctgaaagtaggcattttcacagagcacgtcatagcatatatccagtgggttgctcagtttgtctcgaggagcagcttctttaggagctgttgtgctggctgacttttcctgggataagctgtgcaggtagtgggcagcgacagtccagaagtgcagctccgattcatcaccatagagcctggcaaggatgaagcaaagttttgactgcactcagcacacctggcctggatggcttcctagagtagactgagggactggaagggagtgttgtcacatatccactgggatactggcatggggcctgacagggtgaaagggggaggcagcaagttctcctgccctgctactgggccttcaacaatacgggggcctgactgcacaggaccccttcagactccagcatctttctgttctgtgttaagaacaattatttacctggtttgccattagcacacctttcaatgtgggccattgattcacattaggaagaagttcctctgggataactggctagataaggtatgaaagtaatgtgctatttattctgtggggagaggagtcttttttataagtgacaaactctactgtaagtcaggatatagaggttatcgcttctaaatataatttattggtatatttaaatatacctgtatctgatattttaaaacacatattttaaaaagctgtaggaggaagtgctttccagagagaaggcctagatctcacatttaaaatgcaatttgatttttccctatttgttattactactgtcaaaattattttaagttaaatctaaaggatgaactgatacatttttctaaaatctaagtgtttctaactaaaaacccttaaaagaaatgagttaacttgaaatcctgtctcttatacagaatacatcaaacaatattaccttgaaacaagcaggcacctctgcaagagagtgaattctggatcaagcaacagtttctttatgtcactgtggaagaaatccggacaaaagtgagacaaaagttttcaatcaaacaataaagcatgggggttgatcaatatactcttgaaatgaaaaattccagtcaaataacatgtttagaatttacacaagacaaggtactttaccatgaccctgaaattataaaagttgaagggggctgagagtgttctcaaggcttggagaagcagcagctttcagccaccacagggagctgcagcgctctcatttctggtttataggcttacaacagtttttgaaagtattagctgcctaactactggaacaagaatgccattgttgaaaaaatcatcaagaacagtaaatactttaaagaagatgacattcgtaatttattctgaaactattccaaaaataaagtatctaaggaagaatggcttgtgcttttataagttcgtatttctaaaatagtaaaatactgaatattcacaaatcagaaaggaagacattctttaaatctatagtttcccatttaaacataaatgttaatctttgcatagaaaaaactaattattttgaattttccgtcaataaaatatcatgcttaatttgttaaatactataattatatgtaacagattctagattgcaaaaatgtgttacgctttccccaagaactccttgtagacccatattttttcctttcttattcccagtacattctgttaaatgcccttggctctagggagcacattaatttcttagccagacctgtgcacaccagcacctgacacagagaactcattttagaagcgggaagcagacccagaatcaccctgcgattcgtctcccgctgtgaggcttcatggaggtttgtagtagaggcaagctgagctacaaggatgctcccactatgcatctagtcctgccttgatgtgagatcagagcagctggtgctcatgaacttggtgaagacagatgctctgtcactgtaactactgaataagtactttttctgcaaaacacagactctaacgggaagcaaacctctaaacagaatggtctcttcttgggccactaatattttctaaaacgtaacttattttaattttgaattgcatttaaagttgaattgcatttttctttctcatattcctatcttctaatgaaacatggagtgcttacttagacaatgaattcaactgttcttggaggagattctttatttc

SEQ ID NO: 13022 - DNA, 218 bp, Homo sapiens
ttattattttttgagacagagttttgctcttgttgcccaggctggagtgcaatggtgcgatctcggctcaccacaacctctacctcctgggttcaagtgattctcctgcctcagcctcccaagtagctgggattacaggcatgtgccaccacgctgggctaattttgtacttttagtagagacagggtttctccatgttggtcagtctggtcttgaac

SEQ ID NO: 13023 - DNA, 4045 bp, Homo sapiens
aggaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccagatgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgcccccaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtttttgtgctctttggttcttgttgtaggtattgactgtcctgggatatcactggtcatttaaattcaccatataattagccgggcatggtggcatgtggtggtggctgaggtgggaggatcgcttgaggctgaggtgtgaggctgcagtgaaccatgttcacaccactgtactctagcttgagcaacagagcaagaccctgtctcaaaagtaaataaataataaagtaaatataaatccatgatgccgttactcaggggtagacagactttctgtaaaaggccagataataaatctgctaggctttgcaaacc

SEQ ID NO: 13024 - DNA, 809 bp, Homo sapiens
cctttagcttggagtagtttgatcgtctgaagccttctcttaactcgtcaaagtcattctccatccagctttgttccgttgctggcgaggagctgcgttcctttggagggggacaggcactctgatatttagaattttcaggttttctgctctgttttttccccatcgttgtggttttatctacttttggtctttggtgatggtgacatacaggtggggttttggtgtgcatgtcctttctgtttgttagtattccttctaacagtcaggaccctcagctgcaggtctgttggagtttgctggaggtccactccagaccctgtttgcctggatatcagcagcagaggctgcagaacagcgaatattgctgaacagcaaatgttgctgcctgatcgttcctctggaagctttgtctcagaggggtacctggccgtgtgaggcgtcagtctgcccctactggagggtgcctgccagttaggctactcgggggtcagggacccacttgagggggcagtctgtccattctcagatctcaaactccatgctgggaaaaccactactcacttcaaagctgtcagacagggacatttaagtctgcagaggtttctgctgccttttgttcagttatgtcctgcccctagaggtggagtctacagaggcaggcaggcctccttgagctgtggtgggctccacccagttcgagcttcctggctcttttgtttacctcctcaagcctcagcaatggtgggcgccctcccccagcctcgctgccaccttgcggatggatctcagactgctgtgctagcaat

SEQ ID NO: 13025 - DNA, 381 bp, Homo sapiens; identical to SEQ ID NO: 13008

SEQ ID NO: 13026 - DNA, 552 bp, Homo sapiens
tcatgcatatatactcttaacaaatgaatacttatcattgcttttttcaagcaacaaatatattactttagctctctcagagtaagattacaacaattgtggaacttactgggttttgtaggaaaagctagtttctaattaaactcttaatctatttttagtgctgagtacatattgagaaagtggaatatttccagtgggctgggtagaaatacttttcattgcgcaaccaacatgaaaggatgacttatttccatgccagctgtgctcagttttcctgaccttaatggaacatattatatccacctgctggaatatttactctaatggaataaagcacttggattctttccttgcctatattccaaagaggacagagtggaccaaaatatgtactcgttggtagcactataaaatcttcatgatagatacacttgacaactcttaaaataattgtctgtgccaatggggaaaaatgtgtataatacacacaacactatgtgaatatccacaatgcgcacatattttcatatattcttacatctttcttat

SEQ ID NO: 13027 - DNA, 1019 bp, Homo sapiens
aagagtgacagaatctgtttaatgttttaacaagatcatcctggttgctggatgaacaatacacgaaaggacaataaagggagaaggatgaaggccagatggagattgcatcagttagattttgctatacgagagataaccagaaaactccagtggtatacagtgataagtttttatttttgtgcttagagtttcagctgatctagggtggctctgctgatctcaggtggatttgttcgtgagtctaagggttggatgggggttggctgacctaggctgggcccacatttgaggtcatgaaaagtgtgtctttgatctcatgtggcttggccacaacatttttaaggcacccttctctgacttgcacaaatttttattcccatattataaatgagtaaacaagttctgaaaaatgaagtggcttgcctacattaagcttctagcaaattgaaaagctacttcttggatgaagatctcaacttcaaatcctccacaaaatgcttctcctaatgtctaatgccattgagatacatagaggaatgttatttaatatgtgcaataattttttgagataggtattactaccccattttatcagtaaggaaattaagaccaagaaagggtaagaaaactgtactgattcacacagcatattagaaacaaagtgaaaactcaaattcagtggcttgctaaattttcattgcctttttttttttaaaagcatgccactgctatctaataaagatcacatttatctaagcttgcaaggatccaggaactctcccaatgatgaacttaaaccaaatcccacatattccctatctactccccactcccaccccaggccattgggctccttttagaacctgcacagaagtgtctcctaatcttgggggaaattaaactgtctactaaagaaatcactagatgtctacatttcctgatcttaaaagtttgcagttattctgtcatgaaataggaagtgaagcaactacagttctctcttctcaaaacagaag

SEQ ID NO: 13028 - DNA, 122 bp, Homo sapiens
agtgctgcaataaacatacatgtacatgtgtctttatagtagaatgatttataatcctttgggcatatacccagtaatgggatagctgggtcaaatggtatttctggttctagatccttgag

SEQ ID NO: 13029 - DNA, 280 bp, Homo sapiens; identical to SEQ ID NO: 12994

SEQ ID NO: 13030 - DNA, 2312 bp, Homo sapiens
ttttttttttaattcctatctagtttctttcaggaaatttctccatgtggaaatttctcctgtttaatgatgtccacagaccagccttctaaagagaattcttattttgcagtaggctcactacagatttgatgatggaattatctgccagatgcccagttctccctttgaggatacacagatagactccagtgtcattagactatcttcccctgaaatgcttttactatggctcctgcacaacttcagggtgtgccacctaccagccatccagacaaaaagtcatgctgaccacccaggctgcagcagaaggaggagatgagctctgggcaagtatgaaaagatattgatggcaagaaaactccttttttccccaaaaatatgaaggttaatgataattattcttctcatcaaaatgtttttgtctccctccttccaggtaaaagtgctaatgcttttagaacttacaaaatgaaattggccataacctgagccttcttttgcactcatctggacttatggtcttcatctccaaatgagacaaacaggagagaatggaacttctgagccctaggggcagcattcacttgaaagtcaattacgtccaaagtaagacactcatgataaggacacttctgaaaaacagagtgaggtgtctgctttcatgggagtaaacctattacttccacttacaataataattctcttaacatctccttaatgctccctgataaatctcagctcctcctcaaccagctctaaatgagaatgacaaggaaagttgtatgaggccaagcagaatgagatctgtagctgcttaagagtggctgataattaacccttctctctcttccccaatcccagtgggtccatgacttttggacaataaagcacccaacctgtgacagcactaagtgattcctgtgccacaggcgggaagcctctcagtgaggctgtgcacttaacagtcatcccaatgacagggaggacagtcttatacacaggaagtttataatgaactgaatttgacaatggcagcctgttcatgtgcagaaactaagatcagtgcctggggacaggcagtcaacttttaaatattaaacagcatataaatatgtatagccttgacctgaacacttgagttatacgttctgaataattatcatttctgaaagactaagggatagatttaccaaattaaaatacagaatctataggatcatgatgttctgcatttatagcattacacgatcaaagccccatctggataaaaggcaaaggcaactttaaaaaagtccttagagattagatccttgaatctcatctgaagtccactggtttcattttcactatatgttacttcatataaatcgggtaaaaaattatagtcatgatcataagtagggtcttgagatgtggcaatcaaagcctaaagattaatacttaacttcagttttcaaactaagtcccacattatccaaactgaagcaatgagtcagagaaatttcaaaggttaaatgctactgactttaaaaaacataaaaccatttgtaccacatcattctaatctcataaatttaatgctctataaaagtaacagagatacgtttagcaatttgggaaaaccaacgagagatgtcatttgcattgcttttgagatgaaacgtgatgtgataatttaccaagactgatcattataaaataagtgagcaacaagatgagttgagctggaaaggaaagggaggagtgggtttttagatcactaactctgtgactttatggtccagagccacatcaaccatgtgagtcaaaaaactttcaccatttcaaaatgcctggcctgggaattgggggcaatttatttctattggtgtaattacctggatgtgattttaccagcaccagcaagagaataagatccagttttaggaaataatatggatttgttcatccactcccaacacagcttgcttgctcatcctaaaatgatactattgctaagtaatgtctaccactatcgacctattctttagctaaattactaattagtttagcatgtctggttattaaactgcaatggtgagttaaactgtaatgctttcaaaactaaagactggctagtggtcaggtaagctatacctcttgcttctctggtcgagtccacgaagcctggagaaaacaagatataaaacacaacaagaaagcagtaaaattttacaacatgttgctttagagaatgtatcacactgcattccgtgcacatgcagcttttctttaattcagaactttttccaaggcccactttcaatggt

SEQ ID NO: 13031 - DNA, 1859 bp, Homo sapiens
ctgaattccatgtttcattactgggtagaagttacagaacaaatggatttagcttattataaggagaagttttctaattgttagaatttacatatctgtggaatgaggctatttgtcaaactagagagttctttttcccttaaagatgtatagtaagagcagtgcgaacatctcacaagggatgttagatattcttctgtggatagatcttgcacatgatgacctcctgggctctcccagccctgtgattctgagatcacagtgcccatttcaggaatcctcactgtctagacccatccactaaaatgaatcatcatcttattcacatctaagccccattacaagtttattagtatcatccctttcagtggaaatgcgaaatattttattcagttatgctaatgtaattagctcataatgtcaaatgcttgagaagttgaggttgtagttctgctgggtatttgtttctcatgtcaaatatcataccatcagtgaaattgttcataaccaccaaaattaacaattagccccttcagcccctcttccacctttatcatatttatttgcttaacaaatttatctttttttttttttttactcattgattctgaatctccctctatttaaatgtatattctgtgacagcagtcctcaacctttgttgcaccaaggaccagttttgtggaagtcagtttttccacggacaggggcagaacaggggatggttttgggatgaaaccgttccacttcagatcagatcatcaggcattagattctcatgaggagcatacaacctcaattcctcgcatgtgcagttcataatagggttcgtcttcctatgagaatctaatgccaccactgatctgacaggaggcggagctcaggtggtaatgcaagcagtggggagtggctctgaatacagatgaagctttgctcattcaactgccactcacctactgctatgtagcccagttcctaacaggcttcagaatgggggatgggaaccctggttctatgagagcagaatccatgtatctttttgtaccactgaatcccaagcatttcgtgttggtacatttttctgtaagggaatccgtgtcttttgttggcttttaaaatggccacctaaaaaaatttaggaactactataagagtaatgttgtcaaaatcaaataccactgttgagattttgaatctgtgaaggataattgcattcttaatattttgtcttcccttccaaaatcatgctagttagtatttcttcatttattcaagatttcttttatgccaaatagtaaattttggtaattttctttatataggccataaacatgtattattaatttaatttcttggtattttttaatctactaatgggtctactaatgagctttctcaaaggaaggagaggagggaagaagaagggacattggaaaaggatatacagaatatttttatcagtctaggtaaaggttaacttgcctctggtaatctcatttttttaagttctttaagcatatagataattaagaaaataaattggctaggcactgtggctcgtgcctgtaatcccatcactttgggaggctgaagtgggtggattgcctgaggtcaggatttcaagaccagcttgaccaatatggggaaaccccatctctactaaaaatacaaaagttagctgggcatggtggcatgcgcctgtagtcccagctattcaggaggctgagacaggagaattgcttgaacccggtagaattgcttgaacccgggaggcggaggttgcagtgagccgagatcatgccattgcactccagtctaggcaacagggcaaaactccatctccaaaaaaaaaaaaaaaa

SEQ ID NO: 13032 - DNA, 125 bp, Homo sapiens
ctcccaagtagctgggattataggcatgcgccaccatgcccggctaattttgtatttttagtagagatggggtttctccatgttggtcaggctggtcttgaactcccgacctcaggtgatctgcc

SEQ ID NO: 13033 - DNA, 546 bp, Homo sapiens
gagtgcaatggtgtgatctcagctcactgtaacctccacctcctgggttcaagtgattcttctgcctcagcctcccgagtagctgggattacaggcacctgacaccatgcctggctaatttttatatttttagtagagacatggtttcaccatgttggccaggctggtctcttaactcctgacctcaagttatccgcctgccttggcctcccaaagttctgggatcacaggcttgagccaccatgcccagcctaattttctgtatggttatcataattactgctatcattggaagcttcttttttgggggggtggtagtcgggggattccccactatattatatttgaccataggccaaactagttgtaacaattaagaacaaagtcccttattatgatttaggtgtctcttattctcagctccattttgtgactatgattccaaattttaatcctatttgactgtgtggagtaaaccagtggtagagatggaattgatggagctcagaaacatgtaacggaaaagagaatcggccattttctcct

SEQ ID NO: 13034 - DNA, 105 bp, Homo sapiens
tgagacagagtcttgccctgttgcccaggctggagtgcagtggcgcgatcttggctcactgcaacctccgcctcctgggttcaagtgattctcctgcctcagtct

SEQ ID NO: 13035 - DNA, 368 bp, Homo sapiens
ggaaaaggaattcgctgaccccttgcactttgtgggtgaggctatgccccaccctgctttggctcacactccttgggctgcacccactttccaacaagtcccagtgagatgaacctggtacctcagttggaaatgcataaatcacccatcttctgtattgctcacactgggagctgtagactggagctgttcctattcggccatcttggatcagcctccttaagtagaaagtttaatccatttatcttaaagttactattgacacgtgagagtgtattcctgtcattttattaattgatatctggttgtttttatgttctttgtttcattctttcttattatgattgtggtttggtggttttctgtaa

SEQ ID NO: 13036 - DNA, 223 bp, Homo sapiens
ccacctatgagtgagaacatgcggtgtttggttttctgtccttgcgatagtttgctcagaatgatggtttccagcctcatccatgtgcctacaaaggatatgaactcatccttttttatggctgcatagtattccatggtgaatatgtgccacattttcttaatccagtctatcattggtagacatttgggttgattccaagtccttgctattgtgaatagtg

SEQ ID NO: 13037 - DNA, 650 bp, Homo sapiens
taaatctcaatataattctgatagctggaggatagtgtattttcaggtttgctggaggaaaaaaactggactttaaataattaagccaaaataattgtattaattaacttctatccttaatcactaatttcattttttatatttcccttgacttttgggggagaaatagtctttgtctcaaaagtgggctttagtgacctatgggtttgataaagcaaccagagataacgagacacaaggatatttaaatggcaacatgccagcaattattattagttaattggaagcttttatgattttggcctggggccaatgcttttcccctctgctgggctataaagtgggtaagggagaggaaaagctttgtttcactttttaaataaaagtattaagtaactttgaaatttttataaaattaaaagatagtaaaaacaactattctaactgaattcaaaacctgttatgcttcagtggagagattattcaagacaagtccatttgaaattgggagtaaatttctactggtgaagtttgtcagtgatagctatgcacttctgacaaaatacgaaatggggggtatgggcatgtcatatcatcatggtgcagatacgtggatgtgtgcttccaaacaatggcaacctaactcactg

SEQ ID NO: 13038 - DNA, 980 bp, Homo sapiens
aacctacagaatgggagaaaatttttgcaatctacccatctgaaaaagggctaatatccagaatctacaaagaactcaaacaaatttataagaaaaaaacaaacaaccccatcaaaaagtgggcaaaggatatgaacagacacttctccaaagaagacaattatgtagccaacagacatatgaaaaaatgctcatcatcactggtcatcagggaaatgcaaatcaaaaccacaatgagataccatctcataccagttagaatggcgatcattaaaaagtcaggaaacaacagatgctggagaggatgtggagaaacaggaacacttttacgctgttggtgggagtgtaaattggttcaaccattgtggaagatagtgtggtgattcctcaaggatctagaactagaattaccattggatccagcaatcaaatggtaatttgacccattactgggatatatccattaggtagaacccaaaggattataaattatgctactctaaagacacatgcacacgtatgtttattgcggcactattcaccatagcaaagacttggaaccaacccaaatgtccatcagtgatagactggattaagaaaatgtggcacatatacaccatgaaatactatgcagtcataaaaaaggatgaattcatgtcctttgcaggacatggatgaagctggaaaccatcattctcagcaaactatcacaaggacagaaaaccaaacactgcatgttctcactcataggtgggaattgaacaataagaccacttggacacagggcagggaacatcacacaccagggcctgtcaggggttgggggctgggggagggatagcattaggataaatacctaaggcaaatgatgagttgatgggtgcagcaaaccaacatggcacatgtatacctatgtatcaaacctgcttgttgtgcacatgtaccctagaacttaaagtataataataataatttaaaaa

SEQ ID NO: 13039 - DNA, 386 bp, Homo sapiens
ctgcatctgtatttatagatcatcttaagaactattcattttatgccacggagttatagttaatgatacacaactattctttggtagaactgtacctctaagccaatgtttccagttcctgcacttttcaaatgtaccaccatcttcttttgtttcttacatttaattataagccacaaaaaatcatgatcttcgtgtgtacctctggtcatctaccacatagtaagattgggatattggataaataaaagatatctccagaaaaaatgttcctatctaagatggagatactgttggtatgtttaacagtgctgtcttgaaggccattggttttcggagcatgacctgaggttagtcccctgacagagtttttttttttttttttc

SEQ ID NO: 13040 - DNA, 1728 bp, Homo sapiens
ttcaaggagaactacaaaccactgctcaatgaaataaaagaggatacaaacaaatggaagaacattccatgctcatggataagaagaatcaatattgtgaaaatggccatactgcccaaggtaatttatagattcaatgtcatccccatcaagctaccaacgactttcttcacagaattggaaagaactactttaaagttcatatggaaccaaaaaagaccccgcatcgccaagtcgatcctaagccgaaagaacaaagctggaggcatcacactacctgacttcaaactatactacaaggctacagtaaccaaaacagcatggtactgttaccgaaacagagatacagaccaatggaacagaacggagccctcagatgtaataccacacatctacaactatctgatctttgacaaacctgacaaaaacaagaaatggggaaagaattccctatttaacatatggtgctgggaaaactggctagccatatgtagaaagctgacactggatcccttccttacaccttatacaaaaatcaattcaagatggattaaagacttaaatgttagacctaaaaccataaaaaccctagaagaaaacctaggcaataccattcaggacataggcatgggcaaggacttcgtgtctaaaacaccaaaagcaatggcaacaaaagccaaaatggacaaatgggatctaatgaaactaaagagcttctgcacaacaaaagaaactaccatcagagtgaacaggcaacctacagaatgggagaaaagttttgcaatctactcatctgacaaagggctaatatccagaatctacaaagaactcaaacaaatttacaagaaaaaaaccaaacaaccccatcaacaaatgggcaaagaatatgaacagacacttctcaaaagaagacatttatgcagccaaaaaacacatgaaaaaatgctcatcctcactgaccatcagagaaatgcaaatccaaaccacaatgagataccatctcacaccagttagaatggcgatcatttaaaaagtcaggaaacaacaggtgctggagaggatatggagaaagaggaacacttttacactgttggtgggactgtaaactagttcaaccattgtggaagacagtgtggcgattcctcagggatctagaactagaaataccatttgacccagccatcccattactgggtatatacccaaaggactataaatcatgctgctataaagacacatgcacatgtatgtttatagccgcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacactgcatgttctcactcataggtgggaactgaacaatgagaacacctggacacaggaaggggaacatcacacagcggggcctgttgtggaggtgggggttggggggagggatagcatttggagatatacctaatgttaaatgacgagttactgggtgcagcacaccaacatgacacatgtatacatatgtaactaacctgcacgttgtgcacatgtacgctagaacttaaagtataataaaaatatatataaataaaataaaataaaacc

SEQ ID NO: 13041 - DNA, 331 bp, Homo sapiens
catgtcctttgcagggacatggctggagctggaggccgttatccttagcaacctaatgtaggagcagaaaaccacatgctgcctgttctcccttataagtgggagctaaatgatgagaacacatggacacatagaagggaacaacacacactgccgcttgtggaagggtggaggatgggaagagggagaagatcaggaagaataatggatacttattcttcctgaatcacccagggtgatgaaataatatatacaacaaacccgcatgacacatgtttacctatgtaataaacctgcacaccctgcagttgtactcctgaacttacaagtt

SEQ ID NO: 13042 - DNA, 96 bp, Homo sapiens
ccaccacgcctggctaacttttgtatttttagtagagatggggtttcaccatgttggccaggctggtctcaaactcctgacctcaagtgatccacc

SEQ ID NO: 13043 - DNA, 769 bp, Homo sapiens
gtatcccacaaatcatttctatcttgaacttattaatacttcctataaatcagtaagaaaaacacagatgaaccaacagaaaaatgtacaaaagattagaagagatactttacaaaagaagataacaaaatatcccacatatatttgaaaaaatgatccatagcatcaatcataagtgaaattccaataaaaccatgattagatactgtatatactcacttgaattgccaaaatgaaaaagacattatcaagttttggtcagggtatgaaatgattagaaccctcataccagtttgtagaagtgtaaattagtataaccacttcagtaattgtctcgcagtattcattaatcttatactttatgacccagtatttccacacttactcacacgccaatagatgtacacacaagcttaacaaaagatatgtactagattgtttatagcagcaatatttttaatatcctaagacacaaaactacaaaatggtcatcaaaaattagataaataagtcatactcacacaatataatactgtatatcattgagaataaacaattgacaaataaacacaaccatatggatgtgtctcagaaacataatattaaaagaaagaaacccagaaaaatagtgtatgtactgtatgattccataataaagtgaacctatgtgcaaactattctacttggtagaaatcagggtaatgattgcttggacattgggagatggtatcatgagtggaaagggggctttctggagtgttggtacaaa

SEQ ID NO: 13044 - DNA, 479 bp, Homo sapiens
gagaagtttggtcgtctgaagccttcttctctcaactcgtcaaagtcattctccatccagctttgttccattgctggcgaggagctgtgttcctttggagggggataggcactctgatttttagaattttgtttttctgctctgttttccccccatctttgtggttttatctacctttggtctttgatgatggtaatgtgcagatggggttttggtgtggatgtcctttctttttggtagttttccttctaacagtcaggaccctcagctgcaggtctgttggagtttgctggaggtccactccagaccctgtttgcctgggtatcagcagtggaggctgcagaacagcaaatattgctgaacagcaaatgttgctgcctgatcgttcctctggaagcttcatctcagaggggtactcagccgtgtgaggtgtcagtctgcccctactggggggtgcctcccagttaggctacttgggg

SEQ ID NO: 13045 - DNA, 393 bp, Homo sapiens
actgctgtgctagcaatcagcaagactccatgggtaggaccctctgagccaggtgcgggatataatctcctggtgtgctgtttttttaagcccgttgtaaaagcactctattagggtgggagtgacccaattttccaggtgctgtctgtcacccctttctttgactaggaaagtgaactccctgaccccttgtgcttcccgagtaaggcaatgcctcgccctgcttcggctcatgcatggtgcgctgcacccactgtcctgcacccactgtctggcactccctagtgagatgaacccggtacctcagatggaaatgcagaaatcacctgtcttctgtgtcgctcacgctgggagctgtagaccggagctgttcctattctgccatcttggctc

SEQ ID NO: 13046 - DNA, 440 bp, Homo sapiens
accgctcagctcaggacctgacagcgtcactcccaccctcaccaccacacacacaggatgggggactgctgctgctttccagcctgtgagcctggataggtattttgtgacccagctcctgctcagtcccatcgctgtccccggtctctccagggagtaagggattctccgtctgtggtaagttacctgtgactcttcagcagtttcctctgagcataattatatctgagagcacagggagctcctcattccatgtatttttcaaatattcaagatgtacaacgtgatgatttgctataggtattcattgtgaaatgtttgccacagtcaagcttgttgacatacccaccagctcacatttactgttttcgtgtgtgtggtgagaatactcacaatctactctctgagcaaactgcaaatatatgttattagtaactgta

SEQ ID NO: 13047 - DNA, 265 bp, Homo sapiens
tttgagacggagtctcactctgtcacccaggctggagtgcagtgactgatctcggctcactgcaagctctgcctcccaggttcacaccattctcctgcctcagcctcccaagtagctgggactacaggtgcctgccaccacgcccggctaattttttttatttttagtagaggcggggtttcactgtgttagccaggatggtctcaatctcctgacctcatgatccgcctgccttggcctcccaaagtgctgggattacaggtgt

SEQ ID NO: 13048 - DNA, 394 bp, Homo sapiens
agacagggtcttgctctgtcacccaggctggagtgcagtggtgtgatcacagctcactgcatccactagcttctgggccccagtgatcctcccacctcagcttcctgagtagccgggactacaggtgcatgctaccatgaccagctaattttttaattttttgtaggtgtagggtcttgccatgtttctcagaccagcttcaacctcctcagctcaagcaatcccctagctttggcttcccaaagtgctggtattaaaggcgtgagccactctggccagcaaaggaaagttttgttgttgttgttgtttgagatggagttttgctcttgttgcccaggctggagtgcaatggcgtgatcttggctcactacaacctctgcctcccaggttcaag

SEQ ID NO: 13049 - DNA, 440 bp, Homo sapiens; identical to SEQ ID NO: 13046

SEQ ID NO: 13050 - DNA, 265 bp, Homo sapiens; identical to SEQ ID NO: 13047

SEQ ID NO: 13051 - DNA, 722 bp, Homo sapiens
cagcatggtgaccttggcttccaggttgcccccttccagggtcgtgagggtcatgggtgtcaccgattccagattcatctcagggaactccctgtccaccgtcatggccttcagataccacgtccctgacacctggagaaggcccctctctatcaggctcaggccgaccgctccagagcctcccccttccctggcctgcagcccccagactctaccgcaccccaaaggctggagacggggaacattccccaatctaatccacccagaaaacacccagcaccctcgccaggtccacccgaaggtggctccagcccccacaagttggccaggaccacaggagccctcacccccaggagagaagtgaagtcagccagacccccaccttcccagctctgcccttctgcaccccggccccctcccagcccagactcctgctgtcccatctcaccatctttcagggcagggcttttacgcccaacccgaaaatgagggtctccttggatgggggaggcatggggtcttcatccagcagtctcagcctcgccccgtggcccctccagcccagccttcccatccaagcctcacatcctgaatctcctcgtctgaggccaggaggtggtgggcctgcagggcagcaatgaggccgaggctgacggccaggagcaggggcttcatctccgggatctgagtccacggccgcctgacggtttgcttgctggggc

SEQ ID NO: 13052 - DNA, 400 bp, Homo sapiens
gtcttttgggacatgcatggattctctaacatggaagtttgcatcaaaagcaatggcctgggtgtaatgcttagcacatgttttccacgctcattatgtcagtgaattcatttttctccccaagacgttcagccagatgcttccacctcaggtttttgggttgcagctgttattgctggtgtttaaactaggatgccctacctccctcattccccagaaatagatgtggttaaaggaggagtgggtagggtagtctatttgtgacttttgctgaaagttttgcccaggtatgggagacgttggtgggaaagaagtaggtctggagtcaaaggtgaggtagatgccaacaggagttggcacagagccaggtttgagagtgggagccacactgggcaagggg

SEQ ID NO: 13053 - DNA, 391 bp, Homo sapiens
aggacttctccacattggttattctagttatccattcgtctaattttttttttcaaagtttttaacttctttgccattggttcgaacttcctcctttagctcggagtactttgatcttctgaagtcttcctctctcaactcttcaaagtcattctccgtccagctttgttccattgctggtgaggagttgcattcctttggaggaggataggcactctgatttttagagtttccagtttttctgctctttttttccccatctttgtggttttatctacctttggtccttgatgatggtgacatacagatggggttttggtgtggatgtcctttctgtttgttagttttccttctaacagtcagggccctcagctgcaggtctgttggagtt

SEQ ID NO: 13054 - DNA, 722 bp, Homo sapiens; identical to SEQ ID NO: 12984

SEQ ID NO: 13055 - DNA, 560 bp, Homo sapiens
agtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtgagtgtggtttgctatggtgagtctctattgatgcacttatctccagtttacttacatacaaataatttatattttacagatttcttaatggaagtagctttgtttctaattataaaatgtgtaatttttatttgaaaaaatttttattggaaaaacctagatgattcagaagactataaaaaaaaataaaaatcactcaatcctacctctaaaggataaccaccattatagtgtatacagtcagccctccatatccttgggctcagcatctgaggagtcaaccaactgtggtctgaaaatattcagg

SEQ ID NO: 13056 - DNA, 313 bp, Homo sapiens
tcagccgggcgcagtggctcatgcctgtaatcctagcactttgggaggccgaggcaggtggatcacaaggtgaggagatcgagaccatcctggctaacacggtgaaatcctgtgtctactaaaaatataaaaaattagccgggcgtggtggtgggcacctgtagtcccagctactcgggaggctgaggcaggagaatggcgtgaacctgggaggcggagcttgcagtgagccgagatcacgccactgcactccagcctgggtgacagagtgagactccatctcaaaaaaaaaaaaaatgaaatatcacacagg

SEQ ID NO: 13057 - DNA, 150 bp, Homo sapiens; identical to SEQ ID NO: 12868

SEQ ID NO: 13058 - DNA, 297 bp, Homo sapiens
ctcgagtgcctctggagtgtataagaaatacgccaaaagcatccctaaatttagagctctgcaacatatttcaactggagagaaagggggtgggggagagaatatgtatataaaaacagtttttttttctgactctcactgtttctaggattttcaaacttatttttaaaccaatgggaccagttcttcttgtatagaagcctaatgtgtacaatagtaacaaaccaaaacccagagctgctctgacagaagcagaggtaaggaaccaggagttccagataggtctctgtggaagtc

SEQ ID NO: 13059 - DNA, 771 bp, Homo sapiens
gattattccttctcatctgctgcaatggctcaatgtgttaaggagaggagcgagacagcaagaactgcattcattcagtcatacagaccaaaaggaggaatgtcgcccagccccctaaactgacccagaacccagctcatgtctcaactgctacctctactacttagaaagaagtaactccaccaaagcagggttctggacaaatatatttttattgatcttatacaaatagatgaagatggacttggatgttaagaaaaataatactattcaaaatcaagagaagacagtcgcccctagacttaaattaagggtgtgtacattagataatttaatccaatgtatcaggtaaaaacttgaacaaatcttttggcctcttccgtaaaattcagggaagtatgtcctccacaaaacagaatcaaaatataaatgaaagactggcttaagatgaaaggaaaccttataaatgaaaagaagccagatgagagggacttaactgagaatgaaaaaaaactgagtggacaaaataattatgagaagatgaatcttcaaatcagaaagagggaaaaaagctcatttgatactatgggaactcaaaagagagtgaacacaaatgtgaaaattccaagagtacagaaaagtagcataactaaattaagagcatgagaaaatgtacacaattttgagtaataagaacagaaatcaaaagttagtattgtatgttatattttagtagagcaacactgaagacgaatgaaaacaagaaataat

SEQ ID NO: 13060 - DNA, 500 bp, Homo sapiens
aattatcctaacatgttttcttttttcaagactattttggctattttaagtcccttacaattccacgtgtattttagaatcagcttgtaagtttctagacagaaatctgttgggatacttgcagggattacgtcaaatctgtagttcaacttgtaaagtactacaatattaaatcttccaattcatggctgtaagatatttgctaattatttagatcttctttaaacaataatttttaattttcagagtaaaatcttatatcacattttccaaattaattattatttctttttttgatgctattgtaaattgaagtgttttcttaatctcattttagggttttcattgtagatgtgtgcaattgatttttgtatatttatcttgtatgctgtaatattgctgaagtaattaactagttctatcgttcagtggattccttaaaattttctatatacaagaatgttatttgcaaataaagttttatttcctcctgttcaata

SEQ ID NO: 13061 - DNA, 455 bp, Homo sapiens
tgccaccctcccccccatcaccaaagcatcctcctgcctggtcttgctgcttccagcccttcctcctccatgccagtgcccacccagccagagtgaccttcctcatacctcgcttcaaaccttttgttccctttagcagcaaggtcagcttccctgaccttcctcacagggcccatcctaaactggccctggctcatagtcaggcctctgaccccacagcccctgcccctaaccactgtgtttgttgaatacaactggatagacttctcccctacaggtctgtggtctctgctgaaatgcattcacatgcatggagacagggaaacagcctctgttccagggaagcaggggtaggggagcggccgagacgccagacctggctacctttgataagttgtttattttctgaagcagacagttctgataaagccgtcgtaatgatgctccttgatcca

SEQ ID NO: 13062 - DNA, 617 bp, Homo sapiens
aaggactccaggcatgtgccggtaaatgttagtaagttacattttcctagcaattttccatttcacttgtttttaaaattaatacatattttatacaatttattttttaacttcattgcagcaaagtcattaatgttatttattttttattgacaaaaattatttatatttatgtcgtacaacatgatgtttttgatatatatatatatacactttagtttttaaatgtgtgaataaggttcttcataactccatcataacaatgtttgtatttcttacaattataatgtttaaattcatattcctacgggattataaacttctttaggccaggcactagataaattctgtatatgccttagaacttagcacatggtagtcactcatgtacaaattattgagtgtgcaaatgtatgaatgaatgaatgaatgtccacttaaagaaaacaatatgaagctctttttttaatcttcagctcataagttgttttggtacacttttgtccttctcttatttactacttcttattacaatgcagaagttaaagcatgtaatttaggagaactttgctgcatttaaaggataattcaaactcattttagaaaatcattttatt

SEQ ID NO: 13063 - DNA, 417 bp, Homo sapiens
ttttttttttttttttttttgcattttttttttgttttaattttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgatcttgcgatagtttactgagaatgatggtttccaatttcatccatgtccctacaaaggacatgaactcatcattttttatggctgcatagtattccatggtgtatatgtgcc

SEQ ID NO: 13064 - DNA, 400 bp, Homo sapiens
aagctgtcagacagggacgtttaagtctgcagaagtttctgctgccttttgttcagctatgccctgcccccagaggtggagtctacagaggctggcaggcctccttgagctgtggtcggctccacccagttcgagcttccaggctgctttgtttacctactcaagcttcagcaatggcgggcgcccctcccccagccttgctgctgccttgcagttcgatctcagactgctgtgctagcagtgagcaaggctccgtgggcgtgggaccctctgagccaggcacaggatataatctcctggtgtgccgtttgctaagaccattggaaaagtgcagtgttagggtcagggtgacccaattttccaggtgccatctgtcacggcttcccttggctaggaaagg

SEQ ID NO: 13065 - DNA, 293 bp, Homo sapiens
gtattatattttcttttttttttttttgagacagagtctcgctctgtcgcccaggctggagtgcagtggtgctatctcggctcactgcaagctccgcctctcgggttcacgccattctcctgcctcagcctcccaaggagctgggactacaggcgcccgccaccacacctggctaatttttttgtatttttaatagagacggggtttcaccgtgttagccaggatgatttcgatctcctgacctcgtgttctgcctgcctcggcctcccaaagtgctgagattacaggcatga

SEQ ID NO: 13066 - DNA, 296 bp, Homo sapiens
aaagtattatattttcttttttttttttttgagacagagtctcgctctgtcgcccaggctggagtgcagtggtgctatctcggctcactgcaagctccgcctctcgggttcacgccattctcctgcctcagcctcccaaggagctgggactacaggcgcccgccaccacacctggctaatttttttgtatttttaatagagacggggtttcaccgtgttagccaggatgatttcgatctcctgacctcgtgttctgcctgcctcggcctcccaaagtgctgagattacaggcatga

SEQ ID NO: 13067 - DNA, 400 bp, Homo sapiens; identical to SEQ ID NO: 13064

SEQ ID NO: 13068 - DNA, 136 bp, Homo sapiens
ttttttttttgagatggagttttgctcttgtcacccaggctggagtgcaatggcatgatctcggctcactgcaacctctgcctcccaggttcaagtgatgattctcctgcctcagcctcccaagtagctgggatta

SEQ ID NO: 13069 - DNA, 6198 bp, Homo sapiens
gccaactcaggatgagaaactaaaaagcaaaaggggaaatccagggctgagaaattcctagaaaagaatttataactttggctgggagaaggttctctgagttgacaggacgaggcaggaacagccctcagccacacagcttgcagccccgagtactgtggagccatgacatctgtttgcccatttgccctgctcaccgttgtacatcctctgcaggtactgtgcatctgcaaggagagaatggcaggcccctgacagcctgggcagcccaggtaggcaatgggggactcaggacccaaagagcaataccaacggaatctgtagcccggatttgatctgtgagaaaggggcaggacagggaaaaagttaaccttgtaaataagtctgttctggcaatatgtcattagttggggagattgtatggtgtgagggtagggggtttgtgggaacactctgtacttcctgttcaatgttgttgtgcacctaaaactgctaaaacaaaaacaaagtctaattaaaaattggctgagaaaactacaacataaagctgttctgtggccacagagccctgcctagcatcagaagtggtttgttctaggtcaagaggaagactagatacgcaggacccaccaaccaaggcattgtgattgtaggagtcccaagagatgaaagctctcctcttctctcagaccttcagcacaacttttggtgttaaaattccttaaccgtgtacaaattgctttgcattctactgctaaagaacaagtgccatgcaaatacttagggaagagatagactctaacatatgaatagctgaaaacagatcttttcctaagaaaaagatttcatattctaagcttcagtttcctaatctgtgaaatgataacaatataatctgtctgatgcaatgtcctctggatcagtttgtgtttgttgttttaaatacagataggctctcgctatgtctcaaattcctgaacccaagcgatcctctagcctacacctctcaaagtgctgggattataggcatgagccgctgcacctggccccagatcagtttgaagtgagatctttaccaggtcaccacatttaaaagagctaccttcccctcctcaactctcaccagcatttcctagcacccttctttgttttatttttctatatgacatttatcatcatttccatatcatatattttactttttaaattctcttacctttctccctttggaatgtaaattccatgagggcagggatttttgtctgttttcttctatatcctcagcacctggaatattttctggcatatagtaggtcatcaataaacacttattgaatgaataattcatataacatcctcagcacaataccaagtatgtgatcctgttaacaattatttattttcttttcaaagccctgacaaaggtggcattgtcctgatgctttgggaggaccagtgtaaaactagttgtttggtttttcatctctgctccgactttcctcacatggaggtcctctcaggcttaagccaggtagaccagcagctgagctagcctgaaggcagtctctgaagtctgggcaaactgtcctggcttggctttctcaaatgaaaaacaaacaaacaacaacaacaaacccttttctctattcacacttctgatgccaaatgtgtgggtcatactgagcaattctccaattctctggggacaccaactgggtgctggatgtccactttacttcaattatgacactggttagcttgtgctgacagttaacacaagccccacagattaaggactcagtcccacaagactgcccccacttcatttgccaattgcaagtagtgggtctccaggtgacccataacttccggcttgcctacagatcaggggctctcacaatcccctaagctttcataattttctgcagtggctcacagaactcagaaacattctaccattactagtttattacaaaggagagtataaggaatacaaatgagcacacagacaatgcagtacctggagggaggtccaaaagggtaccaagtacaggagcttctgtccccatggagttggggtgcaccaccctcccaacacgtgaatgtgtccaccaacccaggagctctctgaaccccgttgtttagggtttttatggggggttcattgtgtagatatggttggttcaatcactggctgttagtgattgactcactctccagcccctctcccctcccaggaagttgaggtggggaatggggaagggagatatggctgaaagttctaaccctgtcatcaaggcttggtctttcaggtgaccagccctcatcctgaagctggctagggaccccaggtactagtcatctcattagcataaaaaagacagtcatcactctggagattccaaggttcttaaaagctcttgtgccagggaacagagaataagaccaaatataacaaatggtgctcctcttactcctatcattcaggaaatgatgagggttttaagacccatgtgtcaggaactggggtaaaagaccaaatatatattttttattatgtcagacagctataggcagatgattcaaggggcacagttatacctctaatgcctttgtgcaaattataaaaaggtggctccttcaggcccatggattgggaaaaaagcttttattcctctgggctgaaacatctctgagactggggagaaaggcagggctataattcagcccactgtcttccctccccctcggctggacactttagtgcagtacagagacggcacagctgtacctggggctatgggagaaagtggtactgggggccagggatatgtggaagaccaagtgcctcacccttactatgctcaccccaaggatgagactctttttctttccaactgcagtttaattgttgtagggtctcctcaggatgatgctcacctcttgatccttctccaccgtgccttgccctgttccaggcctgtggtatcaatacttaaactgagctgacctaggaagaatgcctttcttgggtgtaaagattgagcaagcaatggacagagccatttgaggaggggcaatgtgttgtcatggaaaggccacacatcctggaatcaactgacctggtatggtggcttgatgggtgtcaacttgatgaggctgaactgcatttcccagaattccctttgctgcgtgtttcccattagtgtggaccacaggagatattgtgtgaaagttggagggaagtagtgaagccacaaccattaagtagctcacacatgtctatgttggcatgaatctgctggctcatttgctgggtcctccaaacacatggatgtttttgccttcccagagctctccactgtgagagcacttgctgttgtgcaccggccccacctcctaatactccaccttgggattaggatttcaatacatgaatttgggagagacataaacattcagtccatcgcaaatctcttgcactcttagcagacagctaaataaaccaaccctgtccctgtccattgatcttcttctcccagttaaaataccagcattttctcaggatatttgaaagctagtgcttttactcaaagaaagagtatgggtagaacctgtaggcaccttactaggctagttggggaggtattttggggtggttctctcccaatcctaccatgagcagcatcatatactttatttggattgataataaaggtgattatttgtgaccttattaacagggaatataaatgcctcagagaaggcttccactgtttaaaactattttccaattttatgagttttctggaatatgaggttattcagagaaggagccctcttgcaactccctggcatcttaccctcagttccatctgcattttccactctcaacatccacgcataaacagccagcatccagccactctctccccttttatcctgctgtgttgtcaccctgtcctccctctgtcttgtcaaaaatgagcaaaggcatattagccaccctgggacggcttgacacggaaaaggtgtcctttcaaaatctcagaatgtcacgatgaactagttgagaaaacagtatgatggactgtactggcttctccaaagtcagcccctgtggaaaaatattgaacatttgactcattcactgacatttgggacagttaaatgggagaggaaaaaaaagaaaggaatgaataaattgcttctttttcctccataggtatctgattcaggcgccaaagcttatgaatcttggaatatagtcagctacaatcatgggttattctccaaatgaagagtccaaacactggcaaaataaaaagcacatttggtccatcacattcctaactataatggatgctgagaaatggatgcactgtaacaacccgcaagtttcctggtactgctgctgtcattgcaaaaccattgcaaagtatccatctcttgcctctgccagaaaaagccagccgttaacagaaactaaacccaaggtcacttactttcacataaagagaatattttggcagctgccaaaattcatttttctaatgtgcacttacccaataacttaagcttggcatcctgggcggaatccaacttgggtaattccattttcacaaccgaattcccccaaggagtttgagctgaacatcacattattcttcacttctccagctatcctctcagtaatcaaacgagtgcttttcatccctgaagcgtcatggaaatataggggtgggggttcaaaaaagggtttcttcttaagaatatagtgatgagaggttccgttatacgaacttagtaaagtcctttggaagtcaagactggtttcatttttttaattattatttatttatttattttttgagatacagtctcactctgtcacccaggctagagttcagcggcgcaatcttggctcactgcaacctctgcttcctgggttaaagtgattctcctgcctcagcctcctgagtagctgagattacaggtgtgtgccaccacacctggctaattttttgtattttagtagagatggggtttcaccacgatggccaggctggtctcaaactcctggcctcaagtgatccacctgcctcagccttccaaaatgctgggattacaggcatgagtcactgcgcccagcctggtttcatttatttaaccaacaggtattgaggtttgtgccaagtgctggtctcaatattgcaggtgcagcaggacataagaaaaggtttctgccctcaagaagtaaatattagaataagtatatgaaatagggctggagagagacacaggaatcagaccattaaggccatgatatggagtttggatattattataagtacagttggagagtattagtggagtgatgatcagattcagggtttttaataagatcactgtgaagaggaagagccattgtacaggatacctgtggaaccagggtcttaaccttctgttgttttccattggaatctaaccattctaggagtcaacacagctatggccagattttcctccttgccattcttcaaacagccttggattctcggtaactcaagaaccaaagagtccaaagccatggtttgaccacatggatcatcagcaccgctccacgactgatgctgctttcccttcttctctagccagctgtacttcgtgagcttcctttggtcattcaggacaccagaaacaaataaactaagaagcattagttcatctccatgagctgctccaagagctttaaaagtaggtcagttgcaaagtccaggagcagaagtatgtgtacatatatgagacttattaaatggtggcattctgggaagagcatcaccactgataaagaatcattgaaactttctatttctgtgaacagtggtaaatataaatcttaaaatcatagaatctgagagtggtagaggacttcagtgatcatcaagtccaacctcccacccaaggtaggattattctatgtggccctgacagggagtctaatgtcctatatccctcccatatcacataaaaacatcagaggagtcagtttaaatgcacactgttctgttggctagggaaggccatcgactgtgacatctattgcccaaagttgcagtctgaagggccaaatagcagatagaaaaagttatgtcttaaagaggggtaaaggtcacaacctagaaggagaacaccaaa

SEQ ID NO: 13070 - DNA, 965 bp, Homo sapiens
ggcactacaggtgcgtgccaccacacccagctaatttttgtatttttggtagagacagggtttcaccacgttgtccatggccaggatggtcttgatcttgaccttgtgatccgcccgcctcggcctcccaaagtgctgggattgcaggcgtgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggcataaaagaaatacaaaaattgcagaggtatctggaatgtacctatttgttaattctatttgtcctttcttttgtttcatcttttgagtaataagctgcttggaaaagtttctgttctttagctgattttttagctataaaaatgtatttgaaaagctcataaatttcaggattgaaaagataattgaaagttttaaaaaaacctaattcattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataag

SEQ ID NO: 13071 - DNA, 1173 bp, Homo sapiens
gacatttaacttgttctcacagcttggctattgcaaataatgctgcaatgaatatctcataagtctcgtatatgtccatagaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggctctctgtcactcaggctggagtgcagtggcacaaacatggcttactgcagcctcaacctcctgggctcaagtgatcctcccatctcagcctcccaagaagctgggaccacaggcatgtgtcaccatgcctgactaatttttttttttaattttctgtaagcatggggtcttgctatgttgcctaggctggtctcaaactcctgggctcaagtgatcctcatgcctcagcctcccaaagtgctgggattacatgtgtaggccaccacacccagccttatatatatatttctaattttgccttagccatgcccttaaaaactaattctactttcaactagttttttttttttccaccttcagtctgtagtattgttcacattttgaaaacaatacctacagtaacctgtgaggtaggacatgatagtgttttattggaccccttttactttatgaattggaaaaattaaatttgcatgtagtttgtaaaaaaaaaataaagaaagaaagaaaaaagaaattgattgagattatttcagcagccagaagtgtgggacaggcagggcagttattcctccttctcagtttggaaactgaagctcagagagtaaacttgtcagtgacacagttattcaagaagttgtcttcagttgagagatacgtttttcacctgtagcttctggtattggaacagtacctttttagactaaacaaattacggttaaaattataaaggtattttcggagtacctggaaaaaatcagcattttgcttttctagttccatttagtaggaagacaggaaagtttggtatacctgaattacatgtgagttatttctatttttctaaaaattcttataaattgtgtaaggtaaaaatgactacttcttgttttatggtaaatatagttatatcctttcaagccactgctgtaca

SEQ ID NO: 13072 - DNA, 149 bp, Homo sapiens
ctgcacccactgtcctgcgcccactgtctggcactccctagtgagatgaacccagtacctcagatggaaatgcagaaatcacccatcttctgcatggctcatgctgggagctgtagaccagaactgttcctattcggccatcttggctc

SEQ ID NO: 13073 - DNA, 449 bp, Homo sapiens
tttaaggctgaataatattgtgtgtatcaatcatatttgcttatccattcatctgtagatggagatttgggctttttctaccctttggctcttgtgaatgctgctataaacatgggtgtacaaattcccactttcagttttttggggtatatacccagatgtgggattactggatcatatggtgattactgttttccacagtggctgtgccatcttactttcccaccagcagtgtgcaggagtcctgacttctccacatccagcatttgctgttctctggggctttgttgttttgctttgctggtggggtttttttgatggcagctatgcttacatgtgtcagttggtattgcattgtggtttggatttacttttttctcatgattagtgatgctgagcaccttatcctgtgcttactggtcatttgcatatcttctttagagaaatgt

SEQ ID NO: 13074 - DNA, 84 bp, Homo sapiens
taatcccagcactttgggaggccgaggcaggcagatcacttgaggtcaggagtttgaggccagcctggccaacatggtgaaacc

SEQ ID NO: 13075 - DNA, 87 bp, Homo sapiens
cttgctgccgccttgcagtttgatctcagattgctgtgctagcaatgagcaaggctccgtgggcgtaggaccctctgagccaggtgc

SEQ ID NO: 13076 - DNA, 620 bp, Homo sapiens; identical to SEQ ID NO: 12967

SEQ ID NO: 13077 - DNA, 491 bp, Homo sapiens
ttttcttataaatctgtttaagttctttgtatagtctggatattagccctttgttgaatggatagattgcaaaaattttctcccattctgtaggttgcctgttcactctgatgatagtttcttttgctgtgcagaagctcgttagtttaattagatcccatttgtcaattttggcttttgttgcaattgcttttggtgttttagtcatgaagtctttgcctatgtctatgtcctgaatggtattgcctaggttttcttctagggtttttatggttttaggtcttacatttaggtccttattcatcttgagttaatctttgtataaggtgtaaggaagaggtccagtttcagttttctgcatatggctagccagttttcccaacaccatttattaaatagggaatcctttccccattgcttgtttttgtcaggtttgtcaaagatcagatggttgtagatatgtagttttatttctgagacctctgttctgt

SEQ ID NO: 13078 - DNA, 140 bp, Homo sapiens
ctgctttgtttacctaatcaagcctgggcaatggcaggcacccctcccccagcctcgctgctgccttgcagtttgatctcagactgctgtgctagcaattagcgagactccatgggcataggaccctccgagccaggtgt

SEQ ID NO: 13079 - DNA, 259 bp, Homo sapiens
cactgaggctggagggcagtggtgccatcttggctcactgcaagctccacctcccgggttcacgccattctcctgcctcagcctcccgagtggctgggactacaggcgcccgccaccatgcccagctaatgttttgtatttttagtagagacggggtttcaccgtgttagccaggatggtctcgatctcctgacgttgtgatccgcccgcctcggcctcccaaaatgctgggattacaggcgtgagccaccgcgcccgg

SEQ ID NO: 13080 - DNA, 143 bp, Homo sapiens
attacaggcatgtgccaccatgcctggctaatttttgtatttttagtagagacggggcttcaccatgttggccaggctggtctcaaactcctgacctcaggtgatctgcccgccttggcctcccaaagtgctgggattacagg

SEQ ID NO: 13081 - DNA, 391 bp, Homo sapiens
ttctttgtgatgggttcgaacatcttcttttagctcagagaggtttgttattaccgatcatctgaagccttcttctctcaactcgtcaaagtcattctccatccagctttgttccattgctggtgaggagctgtgttcctttggaggagaagaggcactctgattttcggaattttcagcttttctgctctggtttctccccatctttgtggttttatctacctttggtctttgatgatggtgacatacagatggggttttggtgtggatgttctttctgtttgttagttttccttctaacagtcaggaccctcacctgcaggtctgttggagtttgctggaggtccactccagaccctgtttgcctgggtatcaccagcggaggctgcag

SEQ ID NO: 13082 - DNA, 479 bp, Homo sapiens
ctttgcagcaacatgggtgcaactggaggccactatcctagagtgaattaacatgggaatggaaaaataagtaccacatgttctcatttataagtgggagttaaacacaagctcactctatataataagctcctaaaatgtgcaaataatcaaatagaaacagggacaaaggagattatgtaaatgttgttttagagaagtgaaaatccaaatggtcataaatacatgacaggatattcaacctcactaataatcatagaaatgcaaactaaaatagcaatcagattttaatcctcattcatcatattcacaaaaatgaaaaagcaatactttagaattagcacttatgctaggataggtactctgacattcttggttgaaatagataacatactaggtttttgaaagcctctggcaatatttattaaaatgaaaatgcatataccttccaatccaggagtctcactcctagttttttt

SEQ ID NO: 13083 - DNA, 714 bp, Homo sapiens
aacttctttgccatgggttcgaactttctcctttggctcagagtagtttgatcgtctgaagccttcttctctcaactcgtcaaagtcattctccatccagctttgttccattgctggtgaggaggtgcgttcctttggaggaggagaggtgctctgatttttagaattttcagtttttctgctctgttttttccccatctttgtggttttacctacctttggtctttgatgatggtgacatacagatggggttttggtgtggatgtcctttctgtttgttagttttccttctaacagtcaggaccttcagctgcaggtctgttggagtttgccggaggtccactccagatgctgtttgcctgggtatcagcaggggaggctgcagaacagtggatattggtgaacatcaaatgttgctgcctgatcgttcctctggaagttttgtctcagaggagtacccggccatgtgaggtgtcagtctgcccctacggggggtgcctcccagttaggctactcgggggtcagggacccacttgaggaggcagtctgtccattctcggatctccggctgcgtgctgggagaaccactactctcttctaagctgtcagacagggacatttaagtctgcacaggtttctgctgccttttgtttggctatgccctgcccctagaggtggagtctacagaggcaggcaggcctccttgagctgcgg

SEQ ID NO: 13084 - DNA, 714 bp, Homo sapiens
ccgcagctcaaggaggcctgcctgcctctgtagactccatgtctgggggcagggcacagccaaaccaaaggcagcagaatcctctgcagacttaaatgttcctgtctgacagcttggaagagagtagtggttctcccagcatgcagctggagatctgagaatggacagagtgactcctcaagtgggtcactgatgcccaagtagcctaactgggaggcacctcccagtaggggcagactgacacctcacacggcagggtactcctctgagacaaaacttccagaggaataatcggcagcaacatttgctgttcaccaatatctgctgttctgcagcctctgctgctgatacccaggaaaacagggtctggagtagacctccagcaaactccaacagacctgctgctgagggtcctgactgttagaaggaaaactaacaaacagtaaggacatccacaccaaaaccccatctgtatgtcaccatcatcaaagaccaaaggtagataaaaccacaaagatggggaaaaaacagagcagaaaaactggaaactctaaaaatcagagtgcctctcctcctccaagggaacgcagctcctcaccagcagtggaacaaagcaggatggagaatgaccttgacgagttgagagaagaaggcatcagacgatcaaactactccgagctaaaagaggaagttcgaactcatcgcaaagaagtt

SEQ ID NO: 13085 - DNA, 3456 bp, Homo sapiens
aagattgaagacattccagccaacaaaatgtccattgcgtggcagctaccacaatatgccctggttacagctggggaggtcatgttctctgtcacaggtcttgagttttcttattctcaggtaagtttttgcaaatagaaggtagaaattgagacattgcttgaaggacaatgaattttaattctagcactgacttaaataggtatgttatctcttttggccttgggtaccttatttatgaccctgaacatatatgacctgaacatcttaactccccaggtcatgacagtacagcatgggagtctatgattttggggttctaggaaagagattaaagattaaaatgaagagctgcagagtcagacttcccgtgttcaaattttggctgcatgacctattgtgtaaccttgagcaagtaaattactatctctgtaatgctgtcgcccaggctggagtgcagtggcgcgatctcagctcactgcattccagcctgagcgacagagcgagactccatctgcctccccggttcaagcgattctcctgcctcagcctcttgagtagctgggattataggcgcacaccaccattcctggctaatttttgtatttttagtagagacagggtttcaccatgttggccaggctgatctctaactcctgaccttggatgatctgcccaccttggcctcccaaagtgctaggattacaggcttgagctactgcgcccagtctgtaatactattttttaaatgtataagaatacgaatagaacttatctcttaggattgtaatgaagattatatgacataatgagtttaaatatattcagttaggagcttcatcttattcttactgtttacattattaacaccctctgaatcaatgtgatagctgaacttaataagagaagttctaacttggaagcttttgtgggagaagtttcctggatgcatggggcatgagggcagtgaagggagtttgtttactttcaaacttgtgtcatccccaggctccctctagcatgaaatctgtgctccaggcagcttggctattgacaattgcagttgggaatatcatcgtgcttgttgtggcacagttcagtggcctggtacaggtatggatctgagggaagcaggattcatttctactcaagtttttcctccagctttctcttctccctttcccccatctctctgcttcccacattccccattcagtgctgtgacatgaaatgggttagatatacagactttaccaggaaaatagacatatgtaagtggcaataatgactacaatatacctatgtgaggagaggccagtgaacccagtctttgtccagcaaaagtctggttaaactggtgatcccaggtcagtctgctccccactcctcatcctgtaaagatctctttagtttcaggtttctccatattcttctcatatttatttccccctgcagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgacttcctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaagtataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaa

SEQ ID NO: 13086 - DNA, 434 bp, Homo sapiens
cagtggggccaagttagactttcctagcatttctcagatcacacctcacatatgtaagtaagcctgcttctttcttgaaggccaagcccctcccatcgccagcacccctctaaccaacaccacctctgggattccctgggactcactccaccatctccccaagaggtgcttcctcctctgccccacagcttcccagggtgggcagtcctgcagtccagcactctcccctacccagcctcttccaagtccactggacccatgacccctactgatattttcctgcacaaactgagtgctacctctgctgctgtgtgagatgtctcaaaccccgagtttccacctagagacactttcctctctggttacattgctttggagactcagtgattcttccctggttgcttggacaaaaccacccaatgtgccctgcccag

SEQ ID NO: 13087 - DNA, 112 bp, Homo sapiens
aggctgaggcaggagaatcacttgaacccgggaggtggaggttgcagtgagccgagatctcaccattgcactccagcctgggcaataagagtgaaactccatctcaaaacaa

SEQ ID NO: 13088 - DNA, 1860 bp, Homo sapiens
cagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggagccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaa

SEQ ID NO: 13089 - DNA, 336 bp, Homo sapiens
atgtcaaagctactaatagtatgtctctcttttgctgcatatctattgtatgaacaaaaaggtctgagtgcccagcacccagccattgcttctctggtacccatctggatcttcctctcagacacaacagttgtaacttttttttctttctagttctcagaaatatttaacatttttgctttgtatagaagtataacatacatacaatatagtcgataattcttaaagtatagctcttttaatatatgtacatctgtgtaaggactaagatcagagttgggcacagtggctcatgcctgtaagctcagctacttgggaagctgagacagtagggtc

SEQ ID NO: 13090 - DNA, 489 bp, Homo sapiens
gaggaagttggccaacgacccgaacctggaagcctgtcccatttgcttagacagatgcatgtttccccgcaattccctgcacagatgggatagttccccaactgtagcaaaaggaactggagctgagactgggaccccttacactctgctgtaggatggaggctggtgagcttgcaccagtggcctacatccatgcttcccagtaatttcctgcatggatgggacagtttaccaactgcagggagaggggctggagccgagtctgggccccttcactgctgtgggacagaggctggcaaacccaccagggtagcccaggcaggcaagcttcccctagaagctccctgcacaggtggggcatttccctgactgtagtgagagaggctagagtagagagtgggatcctttaggacctgctttgggacaaaggctgacaggtccttcaaggaggctcagacagacaaatcattcctgggttgtgggatatgg

SEQ ID NO: 13091 - DNA, 929 bp, Homo sapiens
cagtattaccactctgaatccatatctcttgcttgaaatactgcagtgattagttttgtttctttccagtcttttttttaacctagccataatgtccaagttaccatttaaaaaaaagtttgatttttaactgacaggtagtaattttatatatttatgcaacacagtatggtgtatatttacacatacacatatacatatatacacacacacattgtataatgatcaaatcagactaattagcattgccatcacctcaaatatttattgtttctttgtgatgagacattaaaaatctcttctattttgcaatatataatagattattaactgttgaccctgctgtgcaatagaacaccagaacttatttctcccatttaaactaacttctcatctgttttaccaacctctcctcattctactcctccctactcttcccagcttttgataaccgctattctctgctctacttctatgagatcaaattttttagatttcacatatgagtgagatcatgcaatatttgtccttctgtacttggtttatttcacttaacatgatgtcctctaggcttacccatattgtgacaaatgacaggatttcattcttgtttatggctgaatagtatttcattttgtatatacactgcatttaaaataatccagcagggcgtagtggcttatgcctgtaatcccagcactttggaaggccaaagtgggaggatggcttgaccacaggccttcaagaccagcctaggcaacatagcgagatgccatttctgcaaaaaataaattaatcagacatggtggtgcatgcctgtgttcccagctacttggaaagctgaggtgggaggattgcttgagcttctgtggttgaggctgcagtgagctgtgatcatgtcactgcactccagcctgggtgacagagtg

SEQ ID NO: 13092 - DNA, 139 bp, Homo sapiens
gtaatcctagctacttgggaggctgaggcacgagaatcacttgaacccaggaggcggaggttgcagtgagccgagattgcaccactgcactccagcctgggcaacagagtgagactttgtctcaaaaaaaaaaaaaaaa

SEQ ID NO: 13093 - DNA, 695 bp, Homo sapiens
agctcagagaagtttgatagtctgaagccttcttctctcaactcatcaaagtcattctccatccagctttgttccattgctcatgaggagctgcattcctttggaggaggagaggcgctctgatttttagaattttcagtttttctgctctgttttttccccatctttgtggttttatctaccgttggtctttgatgatggtgacgtacagatggagttttgttgtggatgtcctttctgtttgttagttttccttctaacagtcaggaccctcagctgcaggtctgttggagtttgctggaggtccattccagaccgtgtttgcctgggtatcagcagcggaggctgcagaacagtgaatattgctgaacagcaaatgttgctgcctgatcattcctctggaagtttcatctcagaggggtacccagccgtgtaaggtgtcagtctgcccctactggggggttcctcccagttaggctactcgggggtcacggacccacttgaggaggcagtctgtccattctcagatctcaaactcggtgctgggagaaccactactctcttcaaagctgtcagacagggacatttaagtctgcagaggtttctgctgccttttgttcggctatgccctgcctgcagaggtgcagtctacagaggcaggcagacctccttcagctgcggtgaggtccacccag

SEQ ID NO: 13094 - DNA, 5341 bp, Homo sapiens
tttttttttttttttttttttggtgagaaaggctcagcagctgatagactcagcaacaggcagccaggagctctgaggctcacagctggcagtctagttccactcagtctctacttgagaaattctttctttggaggtacagcagaggccttaggtgagtggcttgtctgctatggcagagattagaggtgctgccagactgccataagtgttaggcagtaacagcagcagctgcttatatgcatgtgaacagctggggaattaatttggtatgcattctcaggagccactcatctgctggcagaggtagccgaagaatgcccttagtgtaagtcctctacaaccatacaccaaatgtgctccctgcatttcaaattccattgtagaaagtctctgataatctcacttataccatgagccattcctcagtatctgtcctcttcctgttagtgttctacaattcctttctccttaatttttctccgctttacaaaatgtcacacagacaagtgcataatacttaaacaagcttttaaaaataatgctcataaatagctttggttctgtcataatatttgtatttataaacattttaagtcaattctcttcttttgttttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggttcttgccaatgcatctgagaatctagggactttctgaaatagtacttccttgctatgaggactgaagttggattagaatccatttcaatgaagatcagatgtcctgagtagaattcttactattgggtcctgaatcttacattaaatattctctcaaattccttgaggcatagcaacttgagcttaccagtttagaaactggagatttgggctgggcgcggtggctcacgcctgtaatcccagcactttgggaggccaaggtgggcggatcacgaggtcaggagatggagaccatcctggctaacactgtgaaaccccatctctactaaaaatacaaaaaattagctgagcctggtggtgggcgcctgtagtcccagctactcaggaggctgaggcaggagaatggcgtgaacccgggaggcggagcttgcagtgagctgagatcgcaccactgcactccagcctgggtgacagagcgagactctgtctcaaaaaaaaaaaaaaaaaaaaacggagatttggttaacaaaatagtcaaagtctctcttatagaagttttgttttattttttgttttttaaaattttttaccattttgtagctgacaagtactgacaataaactgctataagcatgtgtagaaaaaggctcaccttgagtagttaagagtaaggaaaaggaatagtgtgtagcatcgtcttagtggtaagacttaagttgatttagtagcaaatggaagtactagtgaaccacatagatttcagaagtaggagtaaaaggttagaagatgtgtcattttaatcttctctagactttttcttaatttttagaaatgtaagtggactgaacagaggaaaaccaaaacacagctggtcaataataagttaaattaatttgacaaactgcctgctatgcatttcatagcaatttaaggactatataagcaatggataaggcgaaaactctgcctttaaggagatcagtcattggggggaaacagaagcaaacaaacaaaaaggcaacataatagatattaatattaatacaagaattttaaaagcacagagttctataataataggaaaatagagggaatgattgctcaacttttcttgaaaaagagtcaggaaaatattgaccgagaaggcagtcattgacctgagtcttaaagaatgaataaggtttttacagatggagtagggtagggataactttccaggtataaggaagattttgtattccagggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggattttaaaggcaacatgactcttgggaggtagattcaatgtgaggctaatctccgaggtataggaaatacaggaaggaggagcaacaggtcgggtagtggtggaagcaggtttggaaaatatgaatagttttgtaaacgtttttgagtttgaattgccactggggaaggcttttggaaatttatttccagagttcaagactgagctatcattgcagtttgctcagctatttactgagctatctactgtcaatttggatagtatctacagtttgcattgtagatactggatacttggattggctggtgcaccctgtttgtgagactcactggagtttgaagagatgaccactggaaaatatccctaagcagtagctgcaattccacccccaccttggagagccaaaaccctcttcgttttcactctcctgtccttggtcttaagctacttaaagcagcctttagacatagggaaaaattgaaagcctctcttttaagaaaaacattaggtacttctggaatagagagttcaagaaattaggagaaaaatgaacttttgaagctttttctttcccttttttgtttacttcattctcttagttttaaaatgctggtaatggtcttttttttctttttttttttttcttggcgattttaatgctttggaaaagatctcatgcttttatctccaaaggaggaaattaatttgatgccatggaaattagttttctagtcgtatgccttgaatgagtgaagaatttctttttcatggtggtactaaaattggggaaagctatagaaactttcatctggaagcttacacttttcctcttttttgaaaatttggtgagagacttggatattttattattttctgtaaaagagtgtaatttgttgtacaggtctaatattgatccttttttggaagtatggaaagaatctgagtataaagcagaattacctctggatggcatgtattctcaaggacactgtcatagggaaacagtttatttagaagcttgtgtttccaaactgttgaatttgatattcacaaaattggcatgtgtaaactttaagctatttcctaagatgaagatgacaaacttggagggaaacttcattcatttggtttatttttatttttatttttatttatttttatctttttgagacagaatctcactctggtttgagacagaatctcactgtgtcccccaagttggagtgcggtggtgcgatctcggctcactgaaacctctgcctcctgggttcaagcgattctcctgcttcaccctccgagtagctgggattacaggtgtgcaccaccacacccagctaatttttgtatttttagtagagacggtttcgccacattggccaggttggtgtcaaactcctggcctcaaagtgatccgcccaccttggcctcccaaagtggagcccccgtgccccttgtttgtgacctgtcaatataaatatgctcagtagtggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagtattcgtaatctaacacagtattgttgccacgagtacgagtatgtgatagactgttgataataaagaaagcaggcacagttggtcagtcctaagataaaggagatgttttttcttatatgtttgtgcattaaagaaaaaaaaaatcttgaatctgaccaatgatgttttttttccttgtaataaaatttaacaaatgtttggcaagcttctggaatctaaatttgaaattatacatttgtcattttctttaaatatttcttcaccttagctttgattatgagaaatcactgtcctctgctgttcttttttttttttttcttttgaggcggagtctcactctgtgccaggctggagtgcagtggtgcaatctcggctcactgcaacctccacttcctgggttcaaatgattctcctgccgcagcctcccgagtagctgggactacaggtgcatgccaccacacccagctaatttttgtatttttgatagagacagggtttcaccacattgtccatggccaggatggtcttgatcttgaccttgtgatccgcccgcctcggcctcccaaagtgctgggattgcaggcatgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgaagatcagggtcctagagtaacctaatattttgtacattggttatttgactcctcatttttatattacatgttatatcaagggagggggtataaaaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaatttttaagagtcagagtttttttttcttgattaattggatgtatttcacagaatttccaactgctcacgttagttttcttccttttagagttgatctctctaatgtattagatcttcatgcctttgatagtctctctggaataag

SEQ ID NO: 13095 - DNA, 726 bp, Homo sapiens
gacatttaacttgttctcacagcttggctattgcaaataatgctgcaatgaatatctcataagtcttgtatatgtccatacaagatcatgaaaatggacatgtctctgggtattttgaattggtgggacaattttgcttaagggtaggcttagtgggtggctctacatttgagagttctaattcccattcctatatatatttcttttctttttatttatttattttttgagatggggttctctgtcactcaggctggagtgcagtggcacaaacatggcttactgcagcctcagcctcctgggctcaagtgatcctcccatctcagcctcccaagaagctgggaccacaggcatgtgtcaccatgcctgactaattttttttttaattttctgtaagcatggggtcttgctatgttgcctaggctggtctcaaactcctgggctcaagtgatcctcatgcctcagcctcccaaagtgctgggattacatgtgtaagccaccacacccagtcttatatatgtatttctaattttgccttagccatgcccttaaaaactaattatactttcaactagtttttttttccaccttcagtctgtggtattgttcacattttgaaaacaatacctacagtaacctgtgaggtaggacatgatagtgttttattggaccccttttactttatgaattggaaaaattaaatttgcatgtagtttgtaaaaaaaa

SEQ ID NO: 13096 - DNA, 338 bp, Homo sapiens
tccgagccaggtgtgggatataatctcatggttcgccgctttttaagccggtctgaaaagggcaatattcgggtgggagtgacccgattttccaggtgcgtccgtcacccctttctttgactcggaaagggaactccctgaccccttgcgcttcccaggtgaggcaatgcctcgccctgctttggctcgcgcatggtgcacgcacccactggcctgcgcccactgtctggcactccctagtgagagaaacccggtacctcagatggaaatgcagaaatcacccgtcttctgcgtcgctcacgctgggagctgtagaccggagctgttcctattcggcc

SEQ ID NO: 13097 - DNA, 445 bp, Homo sapiens
gtttcgccatgttggccaggctggtctcaaactcctgacctcaggtgatccaccaacctcggcttcccaaagtgctgggactgaaggtgtgagccaccgcacccagcctctaaaaagttttaaaggcatttgtcttctttcgcttaaaacgtaagatattaaaaatattaaaatattaaacttaacatctaatatagttcacattagaatccagccaggcacagtgggacacatttgtaatcccagtgctttgggaggccgaggcaggaggatcacttgagcgcagaagttcaagaccagcctgggcaacaaagtgaaaccccacctctacaaaaaaagttttaaaaattagccagacatggtggcatatacctatagccccagctattcggaaagctgaggtataggatcacctgagcccaggaggtcaaggctgcagtgagct

SEQ ID NO: 13098 - DNA, 561 bp, Homo sapiens
cctgggagtaggaccctccgagccaggtgcgggatataatctcctggtgtgccattttttaagcccgttggaaaagcacaatattagggtgggagtgagccgattttccaggtgccctctgtcactgctttctttgactaggaaagggaattccctgaccccttgcgcttcccgggtgaggtgatgcctcgccctgcttcggcttgcgtgtggtgcgctgcacccactgtcctgcacctactgtctggcactccccagtgagatgaacccggtacctcagttggaaatacagaaatcacccgtcttctgcgttgctcacaatgggagctgtagaccggagctgttcctatttggccatcttggctcctccccccttttttttctttttttaagatgcagtctcactctgtcacccaggctggagtggagcagcatgacctcggctcactgcaacctccgcctcctgggttcaaacagttctgtctcagcctcccaagtagctgggactccaggcacctgccaccatgcccagctaatttttgtatttttagtagagatagg

SEQ ID NO: 13099 - DNA, 433 bp, Homo sapiens
aaagcaatttccttaccaaacattttacatttggttattagttatattctggtattctaacaataacactaataattataagctgttgaaaaattcatcagaccctacatttttatccccacatcctgaaaataaagtgggaaataaggtaaagagtagaaaatctgcctatgtttttcttcggatgacatgagatgctcacctaatatcactcctttagcattttctattaaattgttcattctttcctgggggcatatgaacagcttccattacggtaaatgtcagtcttgagtgcaaacctagaagagggcaaatggaaaacttttagacaataagtcaacttttcttcaaaagttcaaccactatacattccatggtgaaaatatttctatgtacagatgaaacctcttaggtttggggaaatttcaat

SEQ ID NO: 13100 - DNA, 316 bp, Homo sapiens
gtgcacaccaagaaccaagtttcagcttggttactgtgttgaagacacctttgctatatttcaagtcattccttcttttctcaattttttttaattgacaaaaattttatatatcgtgtacaacatcaatccatcttggcatctgtatttgtcagggttgtcttagagggacagaactaataggatatatataagggggagtttattaagtattaacttatataatcacagggtcccacaacaggctgtctgcaagttgaagagcaaggagagccagtcagagtgccgaaactgaagaacctggagtccgatgttc

SEQ ID NO: 13101 - DNA, 10685 bp, Homo sapiens
ctatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggtatgtgtcttttggattttacactgcttttctgtttctggaaagtttgctttttaatatttgtgtataatagcatgtacaaagataattttcatgtcttaggaattatttttagtgtattgttaatatttaatttttagaggattaagaatgcatttcagcagggtaatctagtggaaagaatgcagcctctgaaaatttgatgtagccctttcccgcttttattttttttatttattttttttaaacacaagtgtatcattgtatctctaggcaacaagaattagttgtctgtctgggttccatgattaagtgtcagtgggtaaaaacattctaaatggagttggatttctaaggatggtacccctctggcaaagataaaatgtaatgtcacagaatgtttaactctttgcagatctcagggatgcctgttctcaaaagtggagtcagaaggcttgttatttgtagcccaggtgctgccccagtaggagaatttggttttatgtgaagcactcttcctagttttcaaaaataggaagagtgaggccgggcgcggtggctcccatctgtaatcccagcactttgggaggccgaggcgggtggatcacgaggtcaggagatcgagaccattctggctaacacggtgaaaccccatctctactaaaaaagcacacaaaaaagctagcagggcgtggtggtgggcacctgtagtcccagctactcgggaggctgaggcaggagaatggcatgaacctgggaggcggagcttgcagtgagctgagatcgtgccactgcactccagcctgggcgacagagtgagactccatctcaaaaaaataggaagagtgagattccaactagtgttatgtgcccacctcaggtcacccaacacagattagtgattgtgttatgctagaaattgagctagctgtctaatttgttttaaaacactatctaatatctaactggaaattaatagtattcttcttaagttttgtgagagatcatttagaaaaatttcctgagaggaacagactccccacagtggttaagacactgctgccacaggcaggagaagatggaggcctggattagggtggggcgttaggaatgggggaacatatttacaagctgctatgcgtgttctaatttttctacttgcaggacactggaattaatccctgattgagatttgttattaaaaccttgaagggaagaacatactatcaaagaaattgttgttaaagttatctctgagaaagatttagggagtagagatttggtaatttaaagttaagcggttggttctcttatgtgtttattagcactggaagcagtctccctgctattgtgtagactgggagtccttgggttgtgcttccttggattctttcgagctctgcttgataatcctcttttctgctgtgatccgtgtggcatgtatttaggggttgcatggatgagaaggtcctcaggtcaagtacagttctgttatagcgtactagttgggcattagtgacttgaatcaatcaaggaatgcaaataatgaagaataacagaagcctgtagaatattcattattggatttgttatattattcgcactttaaacacattgaatcgctgcaagtgaattttttattcacacaattttaagaatgttttgccaatgtaatcttttagttcttaattttttagttttaagcaacttagaggaagcatttagtagaaaaatgtctaatgtttactggtcaaactttttttctttctgaataaaattttccttgtccttatatttttcttatgctattttatagcacaggagtttagtagactgcttaaattaagttcagcttactatcttactagatgctgagtttttgaaacatctttcacctcttagggtttgggtagattatgtgtgctgagaaaccttgtagatcaatctaatgttggaagagtctaagaaactcttcattccccccaaccattgtataggacttttatgctgtcaaatataggtatttctgctttattaaaactccttatgccgaggcccatatataacatttatattaatcataaattgatattacagcaagattcaccatgttaattgcagactcccaataggtctttgaaaataattggtttacaaaatttgatttacatagcatttcatacagtacaaaacagggaatgtctctgtatgataccaacagatgaaccttagagtatgccttggacatttctttttgtagtttctccagaatttgttctttattccacttctcatgtctacattttttttttcttcaaaatttgcaggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatggtaaagtcttctaattgaaattaatgttacaattgattttgatttgtgtatgcattttatatgaatactagtctatatggagacattaaacagatttacattcttcggcctgctacacatataacaaatattttgggcttggttgacttgctattaattgtatcatgctatataaatttagatttatgcaccttctgacacctaatatactcagcggttttttttatggagcctaatagatgctgttacacattaggaaacacatttataacaatcaaatggtcttgactgtaagttagcaatctagtatctaactttcttgtttgtgctaacagcctcatcaaggcagtagccatgagttaaatgaatcattacattaagagctgaagtgttagtaccacagattagtagagagtgtcttttttttctttttctggaatggttcttaggtgactcattagcaaaaattacatttgagagacgtccatatttgtgatttaaatataaattaaggtaaagtacataaatgaagtggatatacttgagaatcagaataagattgttagagttgaatattagacctttgttttgtttaatgatgagaatgcggagctacttgctagagactaggaagtagcattctcctattccaggtggattttttcctctcctggttaaaaacagatactttgttagctgagaaaaatcagaactcttcctggtaaacatacagctctatttttgatgctaaattctgtgattttagcatggatagatttaaaacacttttaactggcatcatcccagtttgttcatataccagagattataaactaccctttttctcccctccacagcacaaaatacagcttctaatttgtttttctgaaatctgtgtaggtcttttgaagaaatgcttctttattagaagtgttgcatgtgtgatttttgttttgttttgttttgtttttagctaactgtgtgtcaacagttgtagaattcttttattttttccagtatgttatgatctctaatttcttgttttggcaactctttattggcttatactgtatggcttgagggaaaattttctggtaatatcccacactttcttgtacttcctactaaagtatggaatgattaactagtggaggtatttctcagtctttttgtattaatagttataatttgccatgcattttttcgtgtatttggtccaaactctggttaagtgccttattcctaaaactacctagttcaatctacctgcttcaatatggtgtgtctaatagaactagttttaggttaatattacctggtttgggtttactccaggatttctctcttatcttgatttttgttctgcatttactgccttcctgttccagtatttcagttacaatctaactgctaggaacagattgacactgaaaatagatacagaatccatggtgatacataatgtagttcaagtttttaacttttcaagcgacatgtagctatttttctttacatttttgctatttctttttattataaattagcaaattatatatttatggagtacaaagtgatgttatgatttgtgaatataatgcggaatgattaaatcaaactaatatatccatcaccttaaataccctttttaatggtgggaacatttgaaatttacaatcttgccaattttgaaatgtacatatactattaactgtattcaccatgctgtacaatagataccaaaacaaaacaaaacaaaacaaaaacctaattcttcctgagactttgtacccttttaccaacattcccatattcccaccacctctagcctctggtaaccaccattctattctctacttctatgagtttgattgttttagattctatgtataagtgagaacaggcagtatgtgtctttctgtgcctggcttatttcacttatcataatgtccaagttcatcagtgttgttggaattgacagaattacctttttaaaagctgaatagtgtttcattttaaagaatccacattttctttattcatccgttgttgatggacacttaggttgattctgtaacttggctattgtgaataatgctgcgatgaacacagggctgctgacatctgttctacgtattgatttaaaatattttagatatatatcctgaagtgggatggctggatctgtatttttactgtttctactagcagaaatgatctcatttgggcatttctaagcactttataatcaactcagttaattaagaggactgaattctcaataggaagtcattgtttaaaacacatgcactgaccgtacagtcactttttttttaaacaaaggtaattttgaaatctgcaattgaataatattcttgtattaatgaacttgcatagcctaacagtagtaatgttcatctggataacaggtttagggaacttgttttcagtgaggaggataaggacattctcaacttagcaaactctacagtaaagataaggtttatttattttattttttatttttattttttgactctcctctttagaccagggataagatttatttttattaaaattttgtggaagattttttcctttccagagtgtagttttatagtctttggtttttgtcgtgaagttttatattttgtccttatgtgttttgattccttttaaataattaatgggttcacagaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataagtatgtctttacttccccacatcttctgatatttttttttctaaactctttcttcatttcttcctgttttgatatttgcccaagattggtctaggttcttttaaaaatttttttgtttattccttatgatagaaatccccaaacatacatacatgaaatgatagaaattaaaataatgaaacacctatcacccaatcctagcagctttcatcattgagaagtagcagggtgagcctgtatgttatccttgcaaaagtaatatgtggagtatctgtgtatattgttcatcctttaggcataaatgggcaagcatttttatagcaaagaatgaagtgtttcaggcatacattgcttaaaaattgtggctaacaacctactagttattcacaatccctagaatgaaattgctgccgtaagagggtgactttttactttgtaagtaatttgccaattttatacaacaaagaacagtataattacagttacaggactcataaatgattcggggggagaaaatatttgccacatatgcataataggcataatgtacacagtgtacagaggccatcctcagatacataagaccagtaacctagtagaaaatggaaatggaaaatttacagaataaaaacaagccaatgaggatatttagaaaattattaatcaaataaattattttaaatctcattaatatagattatttgttttatggttagatagtatttccatagttacattgtaatttagttccactgtgggacatttaagattgtttccaatgtttttaccattatgagggttattaaaatgaacatccttacatgtaaatgtttttactaataaggcaatattagcttaatatattggcattttttagtgttgctacaaataacattaatgaagaaaaaactacctagatgttcttattgaaattcagaggaattggaggcagagaacacaggaaactatattccaaagcatgggaaacgtaacagcataaacgtggagatggaaatatggaggatgtggcctagtgtagttccagacatgggtgtgtcataatcaccaaggaggcttttaggtcttgagtaggatctcaggagatgtatttttaaagatgcttctcaagtgacaagcaactttaaaccagcatgtaggggccactgcttaaagactgtgaaggaacgcagttgggctgggctatagtggccttgaattctggactgaggtggtccatcccattgcccattggaatagtgttgaaagttgtgttctgaggcggtgaccttttagatgtggtaattcacttcaggggagttacccggtgatggatgatgtgcagaaaaaactggaaaggactagatgtgggagccaagtgttagaggttcactttattaatttagatgtatagagacctggaatggggagggtgacatttgatggaaagcagcatacagatgaaagacattaagaaagaagcagagctttgggtgtggagagggcatgctcagggatgttaaggatgcacagtagtggactgggagactaatagaactggtgagataaatggagagatagaaggtttgggaggaaattgttaaatttggttttagttgtgttgagtttgagatgagctattcaaatggaacagtccaggaggcttaggggaaggtttttcctagaggtacagatttgaatccttggggtggtagcaatactaaagctgcaggtagtatgaaaattccagaggaaaatggtaacaagtgagtactggtgttctggattttagagaacatccatagaagacagcaaaggagacagagaactaggcagactagagatttgcaatgtcctaaccttcctttgatttcccacatagctgggtactaagtgggtactcagaaataatcctttgttggcgtaagtttcattaccttgtgtgtgttgtagtactgtactctttgtctcttactgtctgggataatttctttgtaatttgatcatgttactacttgttctgtaaattaatagtcgctgtaccctcctgtcttttcctcccaaaatgcaacagctgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggattctgaa

SEQ ID NO: 13102 - DNA, 1011 bp, Homo sapiens
cacacccctctgcttacctgtaaaatattctacttctttctccaactcttggaaaatctcatctgcctcagctttgccaaacaggactgtgtaactgcagtccaggccctcagcccgaatgtgccgccagctagggcctgctgagtggcctccattccctggggcctctctcctgggcctcttccttgtgctttctttgtctcctcccaacacagctggctcttctccagttggctcttgctcctcctgcttcctcaaaaggcccccttgagcccctttcaccaggaatctgtccatcctgtccccacaggaaagaagggacgtcagtggcgaggccaagacagaaattgctcaagttctatccccagtgcaaaaatctgtttgtccaaggggtctcacagcaacattcctagtttcacattttcattttaaagtttaaaaccatgtcctagaaaggaaacagaagatgttaaagccggaagggaccctagggacaatctgatccagggtctcccacgtccacctgtgcatcagaatcagctggctagcttgcaaaaacccagaggtctgcactccacgcctgagcacctgaatttttaaagaactacctcctgggaattcgcacgccacagctaaacttagaaactacaatccaaaccctcattttgcagaaggggaaactgttgcccacagaggcgaagaggtttgcccaaagtcaactgtccacccctttaaggaggaaggacccataactgacctcgctgccccccaccagtgttaaaatagatcagtctagtgatgctcaagtggatacgattcagaagcgagacgcaaagaggttaaacacgggtaaaccgcacgcaaaattctgatatcactgcaacacgtccgtggggtgggggtggcaagagtgctctagcatcgcagctccggcgcagatcggaatcccgcagtcaccctggtggcctcgtggtgggaaagacgcgccccagcgaatcggtcgcgtcactt

SEQ ID NO: 13103 - DNA, 323 bp, Homo sapiens
taacatgaattttgtgcaatactatgaggggaagattggttacttttcaaagaaaccacttattttctctcaaaactgagtgtctaatcaaaggcaattttttagaacaggttatcattggtcaaatgtagtaaaaagttgatattcctcttcaatattcacaagatgactctcttactcttctgtgtctttcgacatagttatttttagcaattacagctctgcctttgtctcatttactatgcagtctgtataaccattattagacattacaggaaagaaagccacatggcttaaaaagtactcattctgtcttatccacc

SEQ ID NO: 13104 - DNA, 396 bp, Homo sapiens
ggagctgtgttcctttggagttggagaggcactctgattttaagaattttcagtttttctgctctgttttttccccgtctttgtggttttatctacctttggtctttgatgatggtgacgtacagatggggttttggtgtggacgtcctttctgtttgttagttttccttctaacagtgaggaccctcagctgcaggtctcttggagtttgctggaggtccactccagaccgtttgcctgggtgtcagcagtagaggctgcagaacagcgaatattggtgaacagcaaatgttgctgcctgatcgctcctctggaagttttgtctcagaggggtacccagccatgtgaggtgtcagtcctcccctcctggggggtgcctcccagttaggctactcg

SEQ ID NO: 13105 - DNA, 2312 bp, Homo sapiens; identical to SEQ ID NO: 12995

SEQ ID NO: 13106 - DNA, 280 bp, Homo sapiens; identical to SEQ ID NO: 12994

SEQ ID NO: 13107 - DNA, 307 bp, Homo sapiens
gggcgcggtggctcacgcctgtaatcccagcactttgggaggctgaggcgggtggatcactaggtcaggagatcgagaccatcctggctaacatggttaaaacccgtctctactaaaaatacaaaaaattagccgggtgtggtggcgggcgcctgtagtcccagctactcgagaggctgaggcaggagaattgcgtgaacccgggaggcagagcttgcagtgagctgagatggcgccactgcactccagtctgggtgagagtgcaagactccatctcaaaaaaaaaaaaaaaaaaaaaaaaaaagaa

SEQ ID NO: 13108 - DNA, 446 bp, Homo sapiens
ctgggctttccaaaatctggttatattgctttctatgtgtcctgaccctactattatctgtcatttacctttactaaatctcactattgattgtaaccatgtaatccttttgattgttctggtttttctggaatgctttgttggtgataattatctagttgtcttttgaaggttgattgtaagtggctggagaagatgagggaatactcttttttgtttgtttttgttttgttttgagatgaagtcttgctctgtcacccaggctggagtgcagtggcacaatctcggctcactgcaacctccgtctcccaggttcaagcaattctcctgtctcagccttccgagtagctgggattacaggcgtgcaccaccacgcccaggtaatattttgtctttttagtggagacagggtttcaccatgttggtcagcctggtctcaaactcct

SEQ ID NO: 13109 - DNA, 420 bp, Homo sapiens
tctgaagccttcttctctcaattcgtgaaagtcattctccatccagctttgttccattgctggagaggagctgcattcctctggagggggagaggcactctgatttttagaattttcagtttttctgctctgttttttccccatctttgtggttttatctatctttggtctttgatgatggtgacgtacagatgggattttgctgtggatgtcctttctgtttgttagttttccttctaacagtcaggaccctcagctgcaggtgtgttggagtttgccagacgtccaccccagaccctgtttgcctgggtatcagcagtggaggctgcagaacagcaaatattgctgaacagcaaatgttgctgcctgatcattcctctggaagcttcatctcagaggggtatccagctgtttgaggtg

SEQ ID NO: 13110 - DNA, 84 bp, Homo sapiens
caccaaacaaaaaaaaacaaaaaaccaaaaaaaaaaaaaaaaaaaaaaaaaacaaaaaaaaaaaaaaaaaaaaaaaaaaaaaaa

SEQ ID NO: 13111 - DNA, 116 bp, Homo sapiens
gctaaggtaggagaatcgcttgaacctgggaggcagaggttgctgtgagccaagatcgcgccactgcactccagcctgggcaacagagcaagactccatctcaaaaaaaaaaaaaa

SEQ ID NO: 13112 - DNA, 392 bp, Homo sapiens
aaagctttgtctcagaggggcacccggccccatatgaggtgtcagttggcccctactgcgaggtgcctcccagttaggctacacgggggtcagggacccacttgaggaggcagtctgttcattctcagatctcaaactccatgcttggagaaccactactctcttcaaagctgtcagacggggacgtttaagtctgcagaaatttctgctgccttttgttcagctatgccctgcccccagagatggagtctacagaggcaggcaggcctccttgagctgcgctgggctccacccagttcgagcttcctggctgctttgtttacctactcaagcctcagcaatggcagatgcccctcccctagcctcactgctgccttgcagttcaatctcag

SEQ ID NO: 13113 - DNA, 798 bp, Homo sapiens
ttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccgtcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaa

SEQ ID NO: 13114 - DNA, 1326 bp, Homo sapiens
catttttcttctttcttctttttttttaaaaagacatttattcagcatcataatcagactattacatttagcaatcaacagcatgggtgcaaaaaaaaaaacaacctacattaaaacccttcgttggaatgctttacactttccacagaacagaagctaaaataatccgttatacaattagtcacaaatacagtcctcgagtttttttcccatacatatgagtatttgtctaaaacatgtctgctttgtagcagctaggccctgccaccactgtgctttgctaaattcacaaatctgttgtaacctgtagcttccctgccacttctctggctctccgctcctgctaaggtttgtttcctaattaaaatcttctgccactgccacagctactgctactactggaaccatcatagccaccttggttttgtggtttggcaaagaattggcctccaccaccataggggccagagcttctgactccaaagtttcatgggtccataatttgaagactgattgttgtaactgccaaaatcattgtagcttccaccacctccaaaattgcttccatcattaccaaatccattatagccatccccaccgccaccataaccaccaccaccatgactgccaccaaagccaccatgacaactgaagcttcctccacgaccaccacctccatgaccatgatcaaagtttccagaaccacttccacctctggctggatgaggcaatggccaactcttgctttgacagggctttcctaacttcacagttgtggtcattcacactatggtatttctgaatgacagtcttatccatggagtcatggttgtcaaaggttacaaaggcaaaatcccttttcttaccactgcctcagtcggtcatgatttcaattacttcaatttttccatactattcaaaataatctcttagttgatgttcttcagtgtcttctttaatgccaccaacaaatatctttttcaaagttaagtgggcacctggtctttgagaatcttctcttgagacagctctctttggttccacaactcttccatccaccttgtgtggccttgcattcatggctgcatccatctcccccacggtgtcatatgtgacaaatccaaagcccctggagggcttggtgtttggatcactcattaccacacagtctgtgagcattccccattgtttaaaatgactcaaccattttgagccattttcaggttgtttcaaagctcaacccttcaatgaagagcttcctcagctgttcgggccctttaggagatgctgacttagacacgatggcagagtgaagacagactttaa

SEQ ID NO: 13115 - DNA, 2451 bp, Homo sapiens
ttttagaccaatatccctgatgaacattgatgcaaaaatcctcagtaaaatactggcaaaccgaatccagcagcacatcaaaaagcttatccaccacgatcaagtgggcttcatccctgggatgcaaggctggtttaacatacgaaagtcaataaatgtaatccagcatataaacagaaccaaacacaaaaaccacatgattatctcaatagatgcagaaaaggcctttgacaaaattcaacagccttcatgctaaaaactctcaataaattaggtattgacgggacgtatctcaaaataataagagctatttatgacaaacccacagccaatatcatactgaatgggcaaaacctggaagcattccctttgaaaactggcacaagacagggatgccctctctcaccactcctattcaacatagtgtcggaagttctggccagggcaaccaggcaggagaaagaaataaagggtattcaattaggaaaagaggaagtcaaattgtccctatttgcagatgacatgattgtatatttagaaaaccccatcgtctcagcccaaaatctccttaagctgataagcaacatcagcaaagtctcaggatacaaaaatcaatgtgcaaaaatcacaagcattcttatacaccaatagcagacagacagagagccaaatcatgagtgaactcccatccacaattgcttcaaagagaataaaatatctaggaatccaacttacaagggatgtgaaggacctcttcaaggagaactacaaaccactgctcaacgaaataaaagaggacacaaacaaatggaagaacattccatgctcatggataggaagagtcaatatcgtgaaaatggccatactgcccaaggtaatttatagaatcaatgccatccccatcaagctaccaatgactttcttcacagaattggaaaaaactactttaaagttcatatggaaccaaaaaagggcctgcattgccaagacaaccctaagccaaaagaacaaatctggaggcatcacgctacctgacttcaaactatatatactacaaggctatagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctattgaataaatggtgctgggaaaactggctagccatatgcagaaagctgaaactggatcccttccttacaccttatacaaaaattaattcaagatggattaaagacttaaatgttagacctaaaaccattaaaaccctagaagaaaacctaggcaatacctttcaggacataggcatgggcaaggacttcatgtctaaaacaccaaaagcaatggcaacaaaagccaaaattgacaaatgggatctaattaaactcaagagcttctgcacagcaaaagaaactaccatcagcgtgaataggcagcctacagaatgggagaaaatttttgcaatctactcatctgacaaagggctaatatccagaatctacaaagaactcaaacaaatttacaagaaaaaaacaaacaaccccatcaaaaagtgggcaaagtcttctcaaaagacttctcaaaaagtcttctcaaaagaagacatttaggcagccatcagagaaatgcaaatcaaaaccacaatgagataccatctcacaccagttagaatggcaatcattaaaaagtcaggaaacaacaggtgctggagaggatgtggagaaataggaacacttttacactgttggtgggactggaaactagttcaaccattgtggaagacagtgtggtgattcctcaaggatctacaactagaaataccatttgacccagccatcccattactgggtatatacccaaaggattataaatcatgctgctataaagacacatgcacatgtatgtttattgcggcactattcacaatagcaaagacttggaaccaaccaaaatgtccatcaatgatagattggattaagaaaatgtggcacatatacaccatggaatactatgcagccataaaaaaggatgagttcatgtcctttgtagggacatggatgaagctggaaaccatcattctccgcaaactatcacaaggacaaaaaaccaaacaccgcatgttctcactcataggtaggaattgaacaatgagaacacttggacacaggaaggggatcatcacacaccggggcctgtcatggggtgggagggaggagggagggatagcattaggagatacacctaatgtaaatgacgagttaatggatgcagcacaccaacatggtgcatgtatacctatgtaacaaacctgcatgttgtgcacatgtaccctagaacttaaagtataataaataaaaattaaaaaattaaaaa

SEQ ID NO: 13116 - DNA, 420 bp, Homo sapiens
cctcgctgccaccttgcagtttgatctcagactgctgtgctagcaatgagtgagactccgtgggcgtaggaccctccgagccaggtgtggatataatctcctggtgtgccattttttaagcccgttgggaaagcgcagtattagggtgggagtgacccgattttccaggtgccgtctgtcacccatttctttgactaggaaagggaattccctgaccccttgggcttcccaggtgaggcaatgcctcgccctgcttcagctcatgcacggggcactgcacccactgtcctgcacccactgtctggcacaccccagtgagatgaacccagtacctcagttggaaatgcagaaatcacccgtcttctgcgtcgctcacgctgggagctctagactggagctgttcctatttggccatcttgg

SEQ ID NO: 13117 - DNA, 464 bp, Homo sapiens
ctatctcagaattgggcacatttctgagatattctgctgcaattgtgtaagatttgtctgcaagccttaattttctcattacctactttttataagtcaggcacaaataattggaactgcttatatagggaaaattgttgaggctttaaaatgtctcaacgccaaatgagaagaaagagaatacatattctttagtcttaatttggttccccaggagcaaacttgaatcctgaaacaagaattcaaactcacagagtttattttgtagggaggaagggaatgaagagaacacaggtaggggagaagagaaataagacaaggaagaggagaaaattaataaagataggcttctcaagccaattaccacagtaggcaactgaaacttaatcccgcatgagcacgctaggggcccgtgaaaaacacatgcttcagggtcccccgagggttaaaggagctgacgtatt

SEQ ID NO: 13118 - DNA, 1091 bp, Homo sapiens
tgatgccttttattctatgaaagtttttcattttaatgaaaaccgattcatcaaaatgttccttttttgcttacgttttttgtgtcttattttttaagctctgtcctgcttcaagtttaaatttctaccaaaagtattgatgttttactttttacatgtatgtgttccataaaaaatccactgagcagatccactgctcaagttctataaaaaaactacagaaatgttgattggaattgcatggaatttgtggattaatttggagaaaagtggtatctttacaatagcaaggctttccatctatgcatttgtatctcttttaatcaagtcttaatttgtgttgtggcagattccgctacttgccttctcaacaaactgctttcttccttgataagaaaatacaaatatgttttagagatggcaatgtgttcagcttcaggtgacgaatacacagtaggcattcaataaatagcacctacttaattatcatcatccccctggtctaccatttggtaaccaaagcgaaataaagttctaagcaggggtcagcaaactacagcccacagttagtctgacccacttacaatttttatgaagaagtttttctggaacacagccaggcccatttgtttacatgttgtctatgtctgcattcgcactagagcagcaaagttgaatgattgcaacagagactatatatagccaccagagcctatctggccctttcacagacaaagttggccaatccctgccttagacggtattctttgcgagatattggtttggaaggttctattcctctatgccagatgcttattgttccatactttgttgcaactaaaagtgtccatggggcccaatgttggctgaatgtttctggaaagacttttaaactcctgataaacgtaatgaccataaaagaaaagcttgctatcaccaactcttccatctatttcctgcctcaaacacagatttgatgcctggaactttgagagctactttgcaattatggggtaactcttatggggggaagagctagagggcaagcaataagcttaaggtggcaggcagagctggctatataatttgca

SEQ ID NO: 13119 - DNA, 617 bp, Homo sapiens; identical to SEQ ID NO: 13062

SEQ ID NO: 13120 - DNA, 2103 bp, Homo sapiens
tcagttgcttgccaaaaagatttattgaagaaaaatgagcaaagtgaaaacagacccatttaagtagtctgtgccagaaaagaatgaagatttatgtccttgaatcgctaacaagagtcataagaagagtgtgatattcagtgtttaagacctggaaaacatggacaaaaattcagaaaacacattttaacagaaagaaaattaaattgatgtatatgtttacagaacatttttctgacaaatatgcatatttgtaaaatatcattttgctttagtttgtatctaacatgtgccaagaaccctatcataaatcttatgtatcttacatgtgggtgctaaacaattactgaattgtcttaattcttatatgaggattaaaaattttttaaatagaagagaatcactgatgaaatactaatgaaaaaattgcttagaacaagcattttgggagaactttttaggctatggtaatgttttggagaggttaatttgcttctcttcatatccttaattctcacttaagtataatattgactgttaactaaatgatatgcatcattaaatgttgtagaaatgagcccctacattgctctgtcttcatactccctgaaggctaggacgaaaaattttacattaagtaattgttagaatattgaaactttgtgatactagggggacccttacactgcggtttttttttctaagtttccgtaaatctgttacatgacctgtagtcctaagcatctgcatttattgagtcgaatacttgccttaaatgcccacattctttcatttctaaaggtttttgcttgttggaaaaatttcttagatgttaaggctagctggctagactattgcacaattctacatggtatcccttttgttgcttttaaatcatgaactcatcgggttcttctttcagtagttcaaagatatccgtttcagttgtggaggtgtcttccttatagtctggggtatctaatacagaggtagttccagaaaatggctcagtgatcttaggtacagtctctgtattatcagtttcagacaaatcttcttctgtagatgattcttccactaggtttgtagctattgatgcagggacaacgaagtcatatctggattcaacagcagtaagcaaaacagaatgggtctctgcttcatttgcagtatctctctccatccaaatactggctccctcggtagtttcttcatcagttagcagagtatcttcccgtttatctttgtctttttcagcagaggtagtgagttcaaacacagtgataaacttctcatcagagtcagttaatgtagccacagcactggtgtcatcttctaaaacacttaggtcaatttcggttattttctcttcttcaagggcagttatgtctggaatagtagtgaagctttcttcaggagcaggagggatttcagcctcaggaatagtggaatcagtgacctggacagcctcatcagcagggacattggatttgatggaggaattataattgctcatatcagcttcatcctttttacgtggaaaggcaggagcgtcagcaacaccagcactgctgtcctttagtgtgccagagacttcagaggttattgagatctctgcatctcctgtgtcaatggtagctaagaggatatcttcttttgctatgtcagtggaaaaatctattaaagaaacagtagtaactggtgatgaaatattcccaattttcactggcatgaaatgttcggtaatagagtctcttgttatggagtttgtagtgccagtcagagaggtaatttctttctgtaggtgagttgttgacttaataaagtcggtccccatatcatcttctgatttgagtttttcctttttagctgtcagtttgttgtctgtagttgttgaaaaatcgctttctagcatatattcatttactgaagtgacgtggtctccttctgaagtaatagttgtttctgatttgggaatagcattgtcagccccaaagaaaatggttgctgcagttggtgttttactgctttctgttggaggatgagaataaattttgggcaaaccatcttcagccatggggcgaagtggcactgtgcactctc

SEQ ID NO: 13121 - DNA, 127 bp, Homo sapiens
tttcaatttttagtagagacggggtttcaccatgttagccaggatggtctcgatctcctgacctcgtggtctccccgcctcggcctcccaaagtgctgggattacaggcgtgagccaccgcacctgg

SEQ ID NO: 13122 - DNA, 505 bp, Homo sapiens
agagaaatggttttggggacaggaagtttataaagccttagtagtggtatgtgcttctggcaagcaacagaaagaacacaaaggcaaaacacacacacacacacacaccccaaattagggataggactagctgcatgtgaattgcaatgaaaagccctgtggggtacttgatggaggaaaataaagatggttggtactactttaattggtagaacaaggtactactctgttatttaaataccaatgcacaacatttcccaaagaaacctttctttatgaattctggaagaaaactttctttgggaaaggttgtgcattgttttattttaagttccagggtacatgtgcaggatatgcaggtttgttacataggtaaacgtgccatggtgatttgctgcacctgtcaacccatcacctaggtattaaacccagcatgcattagctatttttcctaatgctctccctcctcccaccccacccccaaacaggccccagtgtgtgttgt

SEQ ID NO: 13123 - DNA, 3289 bp, Homo sapiens
gggagaatcaacagaaagggaacttctggaactgagaaccaaagtatcccaacaggagcagctccttcagagcacaactgagcatctgaagaacgccaaccagcagaaggagagcatggaacagttcattgtcagccagcgtaggttccctgagagggaacgggggcagaaacaggcagtcttcccgatgccccacttgtgcttcagatgagaagtgatcaggggggcttggggatgttgggagtggagactgatttgatgtccccaaacctcctgtgccaggagcaattgtggctgcagagggaggggaggacagggggtggatagaaggagactccaagctgaatagccagaaagaaataaatgctttagaattctcacgctaagcaagtagggttaatttctgctggtggtttctactctgtggtgctcttttgttgtttcagtaaccagaacacatgatgttttaaagaaggcaaggactaacttagaggtaaggaaactactgcaccagtcagaggcaccaagcctgtcccccacccatcaccatccgttagcagatcttgtaggtgactcttggcctgctttggccttccaggagaagatttggggtccacttgcaagatcacaggtcctcagtgagcatcctgctagtttctgtccctatcaccctcccaccccatcagctcctgcccctgtatcttggttcactctcacattgtcatcatctctcctttttactccaatttttcttctttgaggccaagttcagagactggagaaatgcaattcagctgactcttgaagtcattagacattcgggagtctgcctctgaatgagcttctagtagagggatcttgaggccagttatgtgttctactcttcatgaaaaagtaaaagcaatttgcaacctaataaactgatttcactgcacattcccgggttaagaacagcgatttgattttgctatatctttaagtaacatgacaaaagagatctgttgggtctcattggtctaaaagcaaatttgttaataaataacaactgaaccttcagggaaaaaatgttatatatgtaccagacattatctacatttacttaaaacactaagtgttaatcattccctaggaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtaacccaaaaagtctctagtatccactaaaaggtaacccaaaaatctctagtatccactggctttctccagtgtggaagctttcccctccacctcccatagatcactggaaaggacccgaggcctcggttctaatccctggcttatcactaactgctgtgtggctttggcttgtcccttagtctctgtgagactgctgcaccctcatctgtcaaagatggaactgaacttagttgagctctgaggtccctgtggacttggcccctccacaccctcattatggcaactggacataaacttaacagaggacttcccagcaaaatgtcctcttcttcctacaaacaggctgtttctatatgtgcatgtttcatgctaagcacttctttcttgggtggagatggcaaaggcctctttctgctgagacaaagtgatttggagagtcacctggcccctgaagggggagtggtaggatccagccacccagtgtgcagtgaattggagcagggatctcagcacacagggaggtggggaggctccccctaacctcgggcacctgttgctcctccagactgcagcgcatgctcttagctcatcctcttaactggctctcaccgtgctcctggctttggtcaccacgtagctctcactccagcttcaggtagccatcagtaggacctggcaatatacactgatttggtttgttttatgtttgtctgcaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttctgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagcgtgggtgacagaaaatgaaagtctttttggtgattgtttaagcaagatgtgtataaagaaataaatagtttttctttcactgctttgtttcccatttctgcaccaatcccttgacagtataaagaactggaaagaga

SEQ ID NO: 13124 - DNA, 1263 bp, Homo sapiens
ggagtagtttgatcttctgaagccgccttctctcaactcatcaaagtcattctctgtccagctttgttccattgctggtgcggagctgcattcctttggaggaggagaggcactctgatttttagaattttcagtttttctgttctttttttcccccatctttgtggttttatctacctgtagtctttgatgatagtgacatacagatggggttttggtgtgcatgtcctttctgtctgttagttttccttttaacagtcaggaccctcagctgcaggtctgttggagtttgctggaggtccaatccagaccctgtttgcctgggtatcagcagtggaggctgcagaacagcaaatattgctgaacagcaaatgttgctgtctgatcgttcctctggaggttttgtctcagaggggtacccggccgtgtgaggtgtcagtctgcccctactgggggatgcctcccagataggctacttgggagtcagggacccacttgaggaggcagtctgtccgttctcagatctcaaactctatgctgggagagccactactctcttcaaagctgtcagacagggacatttaagtctgcagaggtttctgctgccttttgtttggctatgccctgcccccagaggtggagtctacagaggcaggcaggcctccttgagctgcagtgggctccacccagtttgaacttccctgcagcttttttttcctactcaagcctcagcaatggcgggcacccctccccaagcctcactgccaccttgcagttcgatctcagactgctgtgctagcaaggagtgaggctcagtgggtgtgtgaccctctgagccaggcatgggatataatctcctagtgtgccgtttgttaagaacattgtaaaagtgctgtattagcatgggagtgacccaattttccaggtgccatctgccacagctttgcttggctatgaaagggaattccctgacccctggcacttcctgggtgaggcgatgccttgccctgcttcagctcatgctcggtgagctgcacccactgtcctgcacccactgtctgacaagccccagtgagaagaacccggtacctcaattggaaatgcagaaatcacccatcttccgcatcactcatgctgggagctgtagactggagctgttcctatttagccatcttggaacagcccctgggttttgactctttatccaatttgccagtctgtgttttttaattggggaatttatcccatttatgtttcaggtta

SEQ ID NO: 13125 - DNA, 1152 bp, Homo sapiens
aatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatg

SEQ ID NO: 13126 - DNA, 104 bp, Homo sapiens
atcccagcactctgggaggccgaggcgggtggatcacaaggtcaggagatcgagaccatcctggccaacattgtgaaacctcgtctctactaaaaatacaaaaa

SEQ ID NO: 13127 - DNA, 154 bp, Homo sapiens
ggcatggtggcgggcacctataatcccagctactcaggaggctgaggcaggagaatcacttgaacccaggaggcggaggttgcagtgagccgaggtggcaccactgcactccagcctgagtgacagagagagaccctgtctcaaaaaaaaaaaa

SEQ ID NO: 13128 - DNA, 459 bp, Homo sapiens; identical to SEQ ID NO: 12973

SEQ ID NO: 13129 - DNA, 337 bp, Homo sapiens
tgcccccagaggtggagcctacagaggcaggcaggcctccttgagctgtggtgggctccacccagtttgagcttcccagccactttgtttactactcaagcctcagcaatggtgggcgcccctcccctagcctcactgctgccttgcagtttgatttcagactgctgtgctagcaatgagtgaggctctgtgggtgtagggtcctccgagccatgtgcgggatataatctcctggtgtgccttttgttaagcccattggaaaagcgcagtattagtgtgggagtgacccaattttccaggtgctgtctgtcacccctttctttgactaggaaaggga

SEQ ID NO: 13130 - DNA, 3089 bp, Homo sapiens
taaagattctttttaacctaaaagacacccaatacttacaaattagaatttattataacttgtacttgaaaacctttaattttccaacttttctcaaatttctcctcagccttagaattggaaaccatgttggccaggctgatctcgaactcttgacctcagttgatccacccacctcggcctcccaaagtgctgggattacaggcgtgagctactgtgcccggcccagaggttaattcttacaaagttaaaataaccattgatgatgacttaaaagcttctttagaacggggttccattgaaaggataagtggaaattgggaggtaaaatggcttaaaacagaaatcaatcattttttgcaatttggcagtctgagttattcagcccagccttctcactgaaaacaataaaaatgctagataaaatgtgtttaaatctggccaggtgcactggctcactcctgtaatcccaacactttgggaggccgaggccggtggatcacctgaggtcaggagttcaagaccaacctggccaacatggtgaaacgctgtctctgctaaaaatacaaaaattagctgggcatggtggtgggcacctgtaatcccagctactcgggaggctgaggcaggagaatcgcttgaatccaggaggcagaggttgcagtgagccaagactgcactgttgcactccaacctgggcaacaagagcaaaactccgtctcaaaaaaaaaagtgtttaaatattctaaaaaaaaatcagacaagataatccaaaatctaaatgaaaacaggagccccaagataaacagagcactaacactacctttgcactatagaaatttgccaaatctgtagactttgaaattcacttgtgactgccaattaaaatttgtatgcacctaataaaatgccttaaaattttgtaaagcaaaagctggcgttgctacaagtaaatttacaatttcagattttaacatatttccttcagtgatagataaataacgggtcagttaattaattaaacctgaatgacatacgtagagaactgcatccaactactaaatacatattcttttaaatacatgtagaacatttaccaaaattaaccttacactgtgccataaaggaagtctcaacaaattgcagggattataatcacaaaaagataactcaaaagtcccaaatgtttagaaattaagcagtacatgtctgataaccccaggtcaaaattgtaatgcaaattttaaaatattttgagtagccaggcatgatggtttatgcctgtaatcccagcattttggaaggccaaagtgggcagatcacttgaactcaggggtttgacactggcctgggcaacatggcaaaacacatctctacaaaaaatacaaaaattagctgggcatggtggtgcgcgcctgtagtcccaggtactcaggaggctgaggtgtaagggtcacttgagcctgggaggcagaggttgcagtgagtcaagatcatgccactgcactccagcctgggtgacagagcaagactccgtctcaaaaaaaaaaaaaaaaaaaatttttttttgaacagaatgtaattgaaaatgtgataaaagagaaaaatgtaaaatgcagctagggccatgcttacaaggaaatgtgtaactttacatgtatatatcagaaaagtatatagctcaggaaataagaaagatttaaaaaacagcaaatcccaaaagaaagtagaagtaaatataaagaacgtaaattaatggaacagaaaacaaacacacaatacagaaaattattaatgataaagccaaacttaatttccttaaaatgccaaatactgttgataaagtacttaagactgataaagcaaaaaagaaaaggaagtacaaattatgaatatcaaaaaacctaaagacatttatttaaagagtaagactatcttatgagcaactttatatcaataaatttaaaaatttagatgaatggacaaattactgaaaaagcagtgtgccaaaaccaataaagaagaaatagaaaatctgtattaaagaaattaaattcatgttaaaatactttgcacaaagaaaacgccaggcccaggaattctttcaaatatttgaggaagaaatattaaccaattttatacaaaactcttccagaaaaaaaaagagcataaaaggaaacactttctagtttgttctctgcagccagcataactttgatatataagcctacaatgacattttaataaaaactaatctgtctcatgtacacagttgtaaaaatcctgaatgaaatattagcatatgaattcaacaatatataaaaagggtaatacaagttaggttcgttctaggaatgtaagatttaacattcaaaaatcaatcagggccaggcacggtggttcacacctgtaatcccagcactttgggaggctgaggtgagtggatcatttgaggtcaggagttcaagaccagcctggccaacatggtgaaaccccatctctactaaaaatagaaaaattagccgggagtagtggcgcatgcctgtagtcccagctactcaggaggctgagttgggagaattgcttgaacccaggaggaagaggttgcagtgagccaagattgcaccactgtactgcagcctgggcaacagagggagaccctgtctcaaaaaaaaaaaaagaaagaaacctgtctcacttatattaacagaataaagggggaaaaagaacctctatatttgtagaaaaggccattgataaaagtcaatacctgttcatgaaaaaaatgttttctacaaaaacacaatcaagaacatatttaacagtgaaacactataaactttcccttgaaatcaggaatgagacaagtgtgtctgctgttcccacttttatttaatatcatcaaagtatagctagcgcaatgaggaaaaagaactatcataattggaaaggaaaaaataaaactataattattcactgatgacagttacacagaaaattcaaaatagtttacaaataattagatctaatgtcacagttctgaatacatggtcaacataatataaatcagtcatttttaaaaacagtca

SEQ ID NO: 13131 - DNA, 103 bp, Homo sapiens
agtctgcctttctgccttcttaatgccggcaaagatcatttttgttccagggatgtacttcttgggattctccacatactccatcagtgtatcctccccccag

SEQ ID NO: 13132 - DNA, 735 bp, Homo sapiens
ttttttttatttcagtgtttctcattgaaatattaagtcacatctacatatatatatatgatgaacttgacattctcgtcagtgagctccgtgatccacgcggtaggctagttggcatacggcgttgcgcccaggtgccaccagcctccatgtcagctccgtggtgactcttcttacacattcttaaatacaagtcctttgtttctataggagatattctcaaagtgggatgtgaatctaagttatgaagcataacaattaaataacatccatacacccatcacttcatgcagaatgaaatatttctagtcctgtggaagctacaggactgctggaatttcttctctgatccagtccccttgcttcatcacagagatgaccactcttctgaaggttatgtccataatccctgtgcttttctttatagtctacatatatatctatgtatagagagggcaggtgtaggtataaatatagatatatctaaaaatatattattttgccatatttatttttaagctttaaaaaatgggtatcatgctgaagtagtatttaccttgaagcacattgtgatcaataaaaacaacaccatcacgcccagtggtataagcatggctcacacagctaatcctggcattttgggaggctgaggcaggaggagttcaagaccagctctaaaaaaaaagggaccaggagttcaagaccagctctacaaaaaatgagacccagacccta

SEQ ID NO: 13133 - DNA, 658 bp, Homo sapiens
tttttttttttgagatggagtctcactctattgcccaggctggagtacagtggcccaatcatagctcacttgtagccttaaactcctgggcccaaacgatcctcctgcctcagcctcctgagtagctaggactagaggtgtgcatcatcattcccagctaatgggtttttttttaaatttgtgtagcagcagggtctcactatattgcccaggctggtctcaaactcctggcctcaggcgatcctcccaccttagcctccaaaattgctagaattacaggcatgagccactgtgcctggaccagaaacttgcttttattaaaggatctcagaactcatcttcatagtactgacctcagtctgtaaatatgtatttattgtattaatgtctatgtacttcaaaatgttgtaagtggcatgagatctgaggttctgtctccctttgctcaccactatatctccagcatccatcaaaatttaagaatccctcagatgtttaacacatgaatttctatacctcagaagttacctgatcacagtatggttagtacaatggctaaattggagtcaaagtgatttggttttaaagtctgaagtactcaatacaattctgtaaggactaaatgatacaatgtccataacatgcttaggatagtttc

SEQ ID NO: 13134 - DNA, 901 bp, Homo sapiens
agaaagtcctactaaacagtactgccattccacattggcaccatcttggggcatcagtcatcccaggaaatggatggtcaaatatgtaaaataagcaattaaatctgagggtataaaacatgtatttcttttttttttttttttttttgagacagggtttagctgggtcacccaggctggaatgcagaggtgtaggcatggctcactgcagcctggagctcccaggctcaaatgatcctcctgcctcaataccctgagtagctgggacgacaggcactgccaccacgcccagctaaaaacatgaatttcaaagctatataaacctttgctatttcataacttaggtccactaagagaaaagcaagctaaaaatagggccaagggaagaatgtcatcatattcactttgcaaactatgagaaccaatacaaatagcaagacacacacatatatatacacatttatacggtctttttttctgactataaccctcccctcccctggactggagcatgatagagtaatgaaaaatgatctcaggttagattaaccagaatgctgagaaagcagacttcctctttaaccaatcatcaatcaacctgctacagtcattttttaaaaaaaaagtcacacgcgcactgccactgccactaccacactaccaccaagtactagccaggttgtggtaaaactggtgttctcccacaactcttctgaaatgcaaaaaaacagtagaaacatcttgaactctagccaaattatactacttgagactgcttccatcacataccctatttcctctgcctgtagtgtttttcttcaccatctttatctactgaaatcctgcttatacgatagtttagcctctggcttaaattccacctcctctgtgatgcctttcc

SEQ ID NO: 13135 - DNA, 824 bp, Homo sapiens
agctcagagaagtttgatcgtctgaagctttcttctctcaactcgtcaaagtcattcccgtccagctttgttctgttgctggcgaggagctgcgttcctttggaggaggagaggtgcttgatttttagaattttcagcttttgtgctctgttttttccccatctttgtggttttatctacctttggtctttgatgatggtgaccgatagatggggttttggtgtggatgtcctttctgtttgttagttttccttctaacagtcaggaccctcagctgcaggtctgttggagtttgctggaggtccactccagacgctgtttgcctgggtgtcagcagcggaggctgcagaatagcgaatattgctgaacagcaaatattgctgcctgatcattcctctggaagtttcgtctcagaggggtacctggctgtgtgaggtgtcagtctgcccctactgggaggtgcctcccagttaggctactcggaggtcagtgacccacttgaggaggcagtctgtccgttctcagatctcaaactccatgctgggagaaacactactctcttcaaagctgtcagacagggacatttaagtctgcagaggtttctgctgccttttgtttggctatgccctgcccccagaggtggagtctacagaggcaggcaggcctccttgagctgtggtgggctccacccagttcgagcttcctggccgctttgtttacctactcaagcctcagcaatggtgggtgcccctcccccaggcttgctgccaccttgcagttccatctcagactgctgtgcaagcaatgagtgaggctctgtgggc

SEQ ID NO: 13136 - DNA, 815 bp, Homo sapiens
ggagctgcatccctatggagggggagaggtactctgatttttagaattttcagtttttctgctctgttttttccccatctttgtggttttatctacctttggtctttgataatggtgacgtacagatggggttttggtgtggatgtcctttctgtttgttagttttccgtctagcagtcaggaccctcagctgcaggtctgttggagtttgctagaggtccactccagaccctatttgcctgggtatcagccgtggaggctgcagaacagcgaatattgctgaacagcaaatgttgctgcctgatcgttcctctggaagctttgtctcagaggggtacccggccgtgtgaagtgtcagtctgcccctactggggggtgcctcccagataggctgctcgggggtcagggactcacttgaggaggcagtctgtccattctcagatctcaaactctgtactgggagaaccactactcccttcaaagctgtcagacagggacatttaagtctgcagaggtttctgctgccttttgtttggctatgcccgccccagaggtggagtctacagaggcaggcaggcctccttgagctgcagtgggctccacccagttcgagcttctgggctgctttgtttacctactcaagcctcagcaatggcgggcgcccctcccccagcctcgctgccaccttgcagttctatctcagactgctgtgctagcaatgagtgaggctccgtgggcgtgggaccctccaagccatgcatgggatataatctcctggtgtgctgtttgctaagaccgttggaaaagtgcggtat

SEQ ID NO: 13137 - DNA, 236 bp, Homo sapiens
gaaggtgaatctctatgtctctcgatttatttgcaatggtgtgaacctgttaagtagtctctgaaaggctactgtttgcatggtgatgttggagattgtggtctgagggcaggccgttgggaagattgctgtaaggtaaggaagattcaagaacaagctggaatcccagcattttgggaggctgaggtgggcggatcacaaggtcaggagtttgagaacagcctggccaatatggt

SEQ ID NO: 13138 - DNA, 560 bp, Homo sapiens
ggttcaggccgctgaaccaggtacacaggtgttccatatgcctgcaattctgcctggttgtggagcagagaggcctccctgcaccacgatctcaggggaacagggtggtggacccagaaatgacacacacagatcagtttcaagttgtcaagcaggccctggctgcatgtcactgtccaggagaaactacagctgtaataattctcctcccatccagactagtaacggggaaagcacaattccagtgcctactgctaaggcactttccacagtactggctgtggaggcccctatcctgctccagagcaggtactctagtctctggcccgagactgaaatgcctgtgcagacacgctgctgcgtcaccaaggaatggctgagtttgtatgcactggtgttaaaagtggcatcctgctctcaattctgggtctgggaaaatgtctgcagcttttccaagtgtctttccctcacagtgtctccaagctttttcctcacccacattcgattcctagatttcagttcctggagcaaagggagagtggggggaacatgttaacact

SEQ ID NO: 13139 - DNA, 2648 bp, Homo sapiens
gtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgcccttttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtgaattactgaacctagagctattttgctctgtaacaacagataaggctaatattttaaaagccacagtatacatcttcttt

SEQ ID NO: 13140 - DNA, 783 bp, Homo sapiens; identical to SEQ ID NO: 13015

SEQ ID NO: 13141 - DNA, 293 bp, Homo sapiens
cctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcc

SEQ ID NO: 13142 - DNA, 658 bp, Homo sapiens
tttttttttttgagatggagtctcactctattgcccaggctggagtacagtggcccaatcatagctcacttgtagccttaaactcctgggcccaaacgatcctcctgcctcagcctcctgagtagctaggactagaggtgtgcatcatcattcccagctaatgggtttttttttaaatttgtgtagcagcagggtctcactatattgcccaggctggtctcaaactcctggcctcaggcgatcctcccaccttagcctccaaaattgctagaattacaggcatgagccactgtgcctggaccagaaacttgcttttattaaaggatctcagaactcatcttcatagtactgacctcagtctgtaaatatgtatttattgtattaatgtctatgtacttcaaaatgttgtaagtggcatgagatctgaggttctgtctccctttgctcaccactatatctgcagcatccatcaaaatttaagaatccctcagatgtttaacacatgaatttctatacctcagaagttacctgatcacagtatggttagtacaatggctaaattggagtcaaagtgatttggttttaaagtctgaagtactcaatacaattctgtaaggactaaatgatacaatgtccataacatgcttaggatagtttc

SEQ ID NO: 13143 - DNA, 191 bp, Homo sapiens
cattctccgtccagctttgttccattgctggtgaggagctgcattcctttggaggatatgaggcactctgatttttagaattttcagcttttctgctctggtttctccccatctttgtggtttttatctacctttggtctttgatgatggtgacgtacagatggggttttggtgtgtatgtcctttctgtt

SEQ ID NO: 13144 - DNA, 124 bp, Homo sapiens
ctcctgagtagctggggttacaggcatgcaccaccacgcctggctaattttgtatttttagtagagatggggtttctccatgttggtcaggctggtctcgaactctcgatctcaggtgatctgc

SEQ ID NO: 13145 - DNA, 742 bp, Homo sapiens
gacatttaacttgttctcacagcttggctattgcaaataatgctgcaatgaatatctcataagtcttgtatatgtccatacaagatcatgaaaatggacatgtctctgggtattttgaattggtgggacaattttgcttaagggtaggcttagtgggtggctctacatttgagagttctaattcccattcctatatatatttcttttctttttatttatttattttttgagatggggttctctgtcactcaggctggagtgcagtggcacaaacatggcttactgcagcctcagcctcctgggctcaagtgatcctcccatctcagcctcccaagaagctgggaccacaggcatgtgtcaccatgcctgactaattttttttttaattttctgtaagcatggggtcttgctatgttgcctaggctggtctcaaactcctgggctcaagtgatcctcatgcctcagcctcccaaagtgctgggattacatgtgtaagccaccacacccagtcttatatatgtatttctaattttgccttagccatgcccttaaaaactaattatactttcaactagtttttttttccaccttcagtctgtggtattgttcacattttgaaaacaatacctacagtaacctgtgaggtaggacatgatagtgttttattggaccccttttactttatgaattggaaaaattaaatttgcatgtagtttgtaaaaaaaaataaagaaaaaagaaa

SEQ ID NO: 13146 - DNA, 105 bp, Homo sapiens
gagacggagttttgctcttgttgcccagactggagtgcaatggcgcgatctcggctcaccgcaacctccacctcccaggttcaagcaattctcctgcctcagcct

SEQ ID NO: 13147 - DNA, 762 bp, Homo sapiens
tcctgcctttgcctcctgagtagctgggactacaggtgcctgccaacatgcccagctaattttttgtatgttttagtagagatggggtttcactgtgttagccaggatggtttcgatctcctgaccttgtgatccacctgccttggcctccaaagtgctgggattacaggcatgagccactgtgcccagccataaactactcttatcttatgtagaaaggctgaatgatgagccaatcaaaaataataactacaacaactttttcaagaaataggcagtgctgtaagatataaatagatactacaaagagttaaaaagcaggtggaggaagttgaggtgtagaacttttattagttcatttttgcttgtttgtttgtttatctaaacagtgttacatttttatcaggttaaaatagtgggtactgagacagtatttgcaagtccatgtgggaatctcaagtcaaaatacataaaatggatacaaaaaaaatagaaagcaagaaactaaactgtatcaacagagaaaatcaccttcactagaaggaagacaggaaggaaagaagaccacaaaacaaccagaaaacaaatgagaaaatggaaggagtaagtccttacttatcaataataacattgaatgtaaatggaataaaccatccaatcaaaacacagagtggctgaatggaggaaaaagcaagatctattgaccgttgcctgcaagaaacacacttcacctatagagacacacatagactgaatgtaaaa

SEQ ID NO: 13148 - DNA, 118 bp, Homo sapiens
cttctctgtattggttattctagttatacattcttctaaatttttttcaaagttttcaacttctttgcctttggtttgaatgtcctcccatagcttggagtaatttgatcgtctgaag

SEQ ID NO: 13149 - DNA, 101 bp, Homo sapiens
aggctggagtatagtggtgcaatctgggctcactgcaacctctgcctcccgggttcaagtaattcttctgcctcagcctcccaagtagctaggactacagg

SEQ ID NO: 13150 - DNA, 98 bp, Homo sapiens
caatgtcactgttctcaccaactttactgcttaaaaatgataattttaagtaaaaatgtgatttacataaacatataagtatattttttttaaatttc

SEQ ID NO: 13151 - DNA, 970 bp, Homo sapiens
tttttttttttacaaaagcacactgaaaccactcttggttaataccaaagctatttacacttgcatagtaattctttaataattatcatgattcaatttttgcacagataactaagtataaatttatatgtttcaggattatgaaatgtgagtgatttctttcaaactaaaatatctaatgtagttaagactaaattatgttcattctagggttcgagtgtttatgttcctgtttccagggctagtggatcattgcatgaaataagagcctatgggaaaagaaatctcagaggaagaagggaaaagaaaaacgaggtgcacatgtttggttcaaggccagttgtcccagatgctagagaagataaaacatacctccaattgtcttctatcccaggcttcatgggcttaagcttgagtcctaaggcaaaggatctacaggtaatgagcaagtgaaatctaaaagcagctgcttgtctatggaatcaccctgggacatggagagcccaaggcatcagcagaattggcactggcagcagcagggcttgcagtgttggcagcagcactaatgacagcagcggtgcagttagtgataacaacatatttggcagcagcaagagttcatttaactccttatacattagctccctgcacctcgagcatacacagccccggtctcgatggtaacagagatggcagacaacagtagaagccgcagcagcagcagtttcttctgtgctaaccagcagcactttcgtctcccagtgactgagagcagagcaaaggaagtaggaaaatagaaaagttgaggaaacataatggtcatgacgggatggaacttacagccagccataactgggttaaaactaaggactgccatttaattatcacacagtttttaaaagtgagttacagtgacactgctcaaatttaacctctctatgcctcaaatttattgtgtataagatggaaa

SEQ ID NO: 13152 - DNA, 1190 bp, Homo sapiens
gggaggggcagctataaaggccgcgccggggccacgaggagcagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcggtgagtgactgcccgcgtcccggcgagccctgcgccctaacagccgggaccggggcctttgggaaaaaccacttcaaccccagacggcggggcgggggcgctgcacctccttgggggacccggcgccccgcaatcgcgctggccccctcgcgtcagggtctcggggcccctcaggctggacccggaccggccctggcacagctctctgacccagtcctttccccacagggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctaccatccggctgtggctcagtgagactcctgctgggagggtggaggcccaggaatgggcgggcaggacaccctcatccagtcctgcggggctggtgtgaaaggcgctgggaaccggctttgaatgaataaatgaatcgtgtcatctgc

SEQ ID NO: 13153 - DNA, 1190 bp, Homo sapiens; identical to SEQ ID NO: 13152

SEQ ID NO: 13154 - DNA, 1190 bp, Homo sapiens; identical to SEQ ID NO: 13152

SEQ ID NO: 13155 - DNA, 2613 bp, Homo sapiens
gacactgccccccatcagggacaaaggtcacccctgggctggcccccatcctctattggggaccttgctcctccatgccctggggaggaagaagagaaataagggtgggtcattgactgggtgctcttggtactcctgcaagaatgtgtgatgagggagaagcagggacccatccaccccagcacaaacatgcttgcacttctctttcctcactaagggctctcagggtccacgtcaaggctccagcagtcgtccaccattgctccctacgtcacactccggaggggtctcaatgccgaaagcagcaaggcgaccttccctgtgagtggccttgagctgtcgaggacctccctgctccttcacatggggagggagggtctcccagggggacagtaactggccatcccttcagccctggggatggcctctggggtggcctcagcccctcctgagctccctgtcacccactgtccaccaaggagggcatcctgcctttctctctggcctgtcagggtggcaggagggagctcaagaagcctgcaccctgggttctggcctcactggacaggcctgagcctaagtgtctgcatctgcagaatgggtgctactcagaaagctcctgagggttgggggcatcgtgttgcttagaggaaatagttctctaaggccaagaggagcccaactagagtgtgcatgtgtgtgagagagagacaacgggaatgcagccagcagggtggctgtcctctgcgtgcccagcccagctgttctgtgtctctcttgcctgcctcctcttcctcagagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgga

SEQ ID NO: 13156 - DNA, 2614 bp, Homo sapiens
gacactgccccccatcagggacaaaggtcacccctgggctggcccccatcctctattggggaccttgctcctccatgccctggggaggaagaagagaaataagggtgggtcattgactgggtgctcttggtactcctgcaagaatgtgtgatgagggagaagcagggacccatccaccccagcacaaacatgcttgcacttctctttcctcactaagggctctcagggtccacgtcaaggctccagcagtcgtccaccattgctccctacgtcacactccggaggggtctcaatgccgaaagcagcaaggcgaccttccctgtgagtggccttgagctgtcgaggacctccctgctccttcacatggggagggagggtctcccagggggacagtaactggccatcccttcagccctggggatggcctctggggtggcctcagcccctcctgagctccctgtcacccactgtccaccaaggagggcatcctgcctttctctctggcctgtcagggtggcaggagggagctcaagaagcctgcaccctgggttctggcctcactggacaggcctgagcctaagtgtctgcatctgcagaatgggtgctactcagaaagctcctgagggttgggggcatcgtgttgcttagaggaaatagttctctaaggccaagaggagcccaactagagtgtgcatgtgtgtgagagagagacaacgggaatgcagccagcagggtggctgtcctctgcgtgcccagcccagctgttctgtgtctctcttgcctgcctcctcttcctcagagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacaccccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgga

SEQ ID NO: 13157 - DNA, 349 bp, Homo sapiens
taagcatctgctttggttttgctcaggggaagagaggctttgagcctgctctgttctcaacaacctgctcagcggtcaaaggcctgtgaggatgcaggtcctgggtcaacaggaagtcaccacggagctggacagtcatggttggatcttatcggttagattttccctcttgggaagcttgttacaaagttgatactgtgaaacagccttagaaacattccatttgatttagcatttcaattttatatgatttagtttttttttctaatttaaagaaaacatctatctcaaatagatgggtctcatacagcagtttttctgcctcattggctccaagctgcttttgctt

SEQ ID NO: 13158 - DNA, 10766 bp, Homo sapiens
gttgcacagacagatggagcagtaccgagaccagccccagcacttggagaagattgcctaccagcagaagttgctgcaggaggaccttgtccatatccgagctgagctctccagagagtccactgtgcgtagagggtggcagacctgtctccctcaggacgggctgagcaaggggctgcttttctcccctcccaagatgtagttgagttggtgtccagaggcaagagtcctgaaatagcagagcttctccagtagcagaactgccacctgacagtagataaccttgtctgggggtgacatgtctgcctgcacgtgtgccttaggctgcttactacagcgactcttgaaggccagtgacacccagtgggccagattcttcagagctgcctgcaaggctgttcccctgatctgtgtgcagttaattccaagttgtcagaatctgctttttcacttttcagtctgttgtggtacaggccagggctgagaatcaaagcatcctgagggtggaagagtgaacagtgcaggtgaccagggtcagagcacaaatgagaggatgccacgctctttcctgctcctctctctctcccaccaggcctgcccggtctccttccctcttcccctggctgggtcagcatggtcaggagtacaggtgttcgtgaggccttccaagggggcaggggataactaagaaccggaagcattgtcttggccaacaggagatggaaaatgcttggaacgaatacctgaagttggagaatgatgtggaacagctgaagcagaccctgcaggagcaacacagaagagccttttttttccaggtgacctgatacctgtccatctcttctgagctcttgttttttgttttttgttttttgtttttccaagagacttcacctgtgggggttgtgagcactgctcagagtccttctccccctcagccccagatgctccacccctgtaaaggagccaccccaagctctcccttgaggatcccttccccaagccaggctgtgatgagaagcttcaccccattccccttgccttgctgctctcaaagacaagctcttgggtgttttagaaagggctttacttctgatcatttggtgtcatcagtaatcacagagtgatccatgttcctgtagttcttggccccatcttaggctgctagctcatcacttagacagcagcaggaagtgcccaccccttccctcctctgattcctggagatagatgttatcacacctctaccagagggagacagtgtgaattctgtcctttgaggcactctggtctccaggcagtcatctgcatttctggaggccaggctgggtgatgcccatctctgtgacccctataccactcaggaaagttggccttagagccctgccacttcacccttaaaaaatcaggccaccctattgatagctgcctctgtcccccagaagtgagacagtgaaaggccctgtgtggtttttcttcttccaaattgggttccaaattgcccagtgttcccccactgtggtgcttaaccaggtttccaccccaccctcacaattttttaagtggaaaataacctgtttttttctcccctgacttaagatctatatcttctcctttcagggccctgacataataagtgtgtttgaattcagcaagcattaattgaggcttcttgtgtatgaggcaccatgctgggccacttttggtgctgggcttgttaactgataagatagttctaaccaaggctctttgtttaagtgatttaatgagtatgttgactctccagacattagcctcaccccagaaagttgaaggaaattctggagtagggtgtaggtgtgtgggccctgaggcttttccaagggccctgctgtccctctattcatgcagagatggttcccagagagccctgcctaggaccacgtggaggagaccctcgcctgtggctcagggctggtctacaagactctccccagcacttgtctatctcctgctgctgttggggtcgttttcctcccataatttctcttcatccacactggctaacatttcactactcttttttgtagccgcagcatttaccgtaatgacttgaaaatactaggtgaatgttgttgacaaagtccttcaattatttctggttatgagtttataaaactgcccaggttatacctattttcttggacttcagtgatctgaatttttttagcagtaatttttttttgctttatttttagcagtaatttttttaagcttttcattctttgttcctgtaattacacaaatggtacatgaatacgtgtctttgaaaagaccaaaacagtaagaagcaaaaacaaaaaatgatataaaagttcctcttccccctctccctttctgcccctcccatcaccctccctatgtgtcatcagtgctatctattggtggcattgccttctagaccattttctatgcattttcaaaaatatgcacatgcatagaatcatatgatttattcaggaatgggagcaggtaaaaggcttacttgaagaggatcacacttacacattatttggcaactcactttttttgtcataacctgatatcgtggaaatctttccaggacagttaatccaaaatttatgctgcccaataaaatataaattaattaaaagtaactgaaattcaaaatgtattcctcatttacaccagactcattcaagtgctccatacccacatgcagctatcggctactgtcttggacagcagggattataggtttctatcatctcagaaaggtgtattgggcagcgccagtctaaggaaattaaacttgtttttcttgactgttacatactatttcatagtctgggtgttttctactttatttagccattcctcttctgatagcatttaattattttcagcgttttgcttttataaatggtggtgtgataaggatttgtgtaactgccttttcacattgtttacaagtatctgtgtaagataggctcctaggagtggacttgctggggttggaatgagtatacatcttaaaagttgatggatatgccaaaccaccttctaaagggctgcacctgtttatcttcctacccacagcaaatgaaagtactggacctatttgctcacatccttgtcagcacttgtaattgatctttttagttttactagtctactaaatggcatcttgctttaatttgcttttatttagttattagcaggttaaatatctattcgtatgattattggccatttgtgtctttactgtgccttatgtcatggtgatttaacatatagcaggcctagaatccttttttttttcccccttccctcccaaaagcaaatagatacactgtgacaggtctttgtcacagacgccctggagaactcagccccatgacttactctcagataggccagcctggagcctgcatcttgatttccaccttgcctgtggcactgctcacactttccctaagtggcacagtaacctgggaagctaacaaagccctgctttgagcaggcactgtgctagcttctttggtgtcattctaggccaggcaggctgttagagccctagaaaaatcatcagcactgcagatgcacttgcagccccatgtgcagattctcagtaacagggcttagaaattcgcctccctgtagtcaggtttggctgcaggaaaatagccttttcagtcaaggctaaaacagtgagttcaaggctttgctgaaagcagcacataggagcctttctacccagtgtggtgggaggaggcaggaatgaaactccaccccctcatttcccccaaaattcccctcccctcattatgaaggcccaaaattccatcaccgttggagaaggatagggactctccagccttttttattctctgctctctgttcttttctcacatgtgggggtgacagaaaggcatcaggggggcaagaaagtggctgacaggggagctttgccagggagctatggaggaggaagaggactgcgtttaatccctttctttacctgttctcaacactcagcttggggacttcagccctagaggtcatcctcttacatacacatgccctgggctcggtaatacacctgtctgttttaggatgctcatgctttggcatggagctgagaatcaaacccattattagcttgccagacctgaggatgtgctttatgttggaggggttgagagagagagtgagaactgtgagccccaccttgggacaggaggctttggacttctgttgtcctggctgttggaaagtatttgctcagggaatttttacatgactggtcctttattcacgtagcatgtatgcactgagaacctgctaagtgccaggccctgtagggatggatcaatgagcagtattgggcaggtccatgaggctcatgcagtgcaagaactcttccagttgaggggtagctaggtgcctcgagaggagatggggtgggaagcctgcctttattttagtccatggggtgggaccaaggctatctttcccccattttaacttaaaagtcaagagaatactacatttgatgtttaaacagccccgtcaagagatggctgtagtcccttaaccccatcagacccctctgcacctcttttagatcctcttcccattcgattttggttgtcagaatgcacatgatcatatagcctaggtccttccccattgtatgtagatatgtatttttttggagtttataatttttttttaattgatatataaaaattgtactcttattgtgctaaaaaaattaacagctttatcatatatttcacatgtcataaaattaaccctttcggctggtcatggtggctcacgcctataatcccagcactttgggaggccaaagcaggaggatcacttggagccgggagttcaagaccatcctgggcaacataacaagacccctgtctctacaaaaactgaaaaagaaaaagaaaaactagccaggcatggtggcatgctccggtactcctagctacttgggaggccaaggcgagaggatcacttgagcccaggagtttgaggttacggtgaccttgatcataccactgcacttcaacctgggcaacaaagtgaccctatctcaaataaataagtaaataagtaaattcacccttctaaagtatacgtttcagtggtttttagtatactcacagcatgatacagccgtcaccgcaatcaattttataacacttcatcatcccccagtagaaatcctgtatccattaacagtcactctcattcccccagcgtcccctctgcccttgccaaacactaatctactttctgtttctactgatttgactagtctggacatttcttataaatggaattatgtaatgtgtggctttttgtgactggcttctttccctcacatgttttcaaggatcatccttgttgtagcatgcatcagcacttcattcctttttattgccaactaatattccattcactactgtatttttaactaaacctcaaatatcgggttcagctgactttttaaaaatgttttttatatcctagagatggtgtaaactctagtccttgccttcccttctgtcatgattacataggacagtgcctttcaaaaaaactgtggtaaaggccaggtgcagtggctcacgcctgtaatcccagtactttgggaggccgaggcaggcagatcatctgaggtcaggagttcaagaccagcctggccaatgtggtgaaaccgcgtctctactgaaaatacaagaattagccagatgtggtggtgggcgcctgtaattcagctacctggttgggaggctgaggcaggagaaatgcttgaacctgggaggtggaggttgcagtgagccgagatggcgccattgtactctagcctgggcaacaggagtgaaactccatctcaaaaaaaaaaaaaaaaaaaaaggaaaaaactgtggtaaaatacgtagaacataaatttaccacctttattattattattttgttgagacagggtctcactcttttgcccaggctggagtgcagtgatatgatctcggctcactgcaacctctgcctcccaggttcaagcgattctcatgcctcagcctcccaagtagctgggattacaggcgcacaccaccatgcctggctaatttttgtatttatagtagagatggggtttcacatgttggccaggctggtctcaaactcttggcctcaagtgtttacctccttggcctcccaaagtgcggggataacagacaagagccattgcacccgactcatcttgattatttttaagtatacagttcagtggtgttaagtacattcacatttttgtgcgcccaatctccagaactttctatcctgtataactgaaacattatacacattaaatagttctgcattcttccctctcccccgcccccagcaaccactgttgtacttcctgtctctacgaaattgactactctaagtatgtcatacagtattttagcggaatggcacagtgtttacggcagtctgtttttaaattaggtaggcaagctggactgctgaaagctactctgaaatttctccctggatcgtgggcattttccttgtctatgcttacctagaaagctatgaagcaggcttggttctagcactagtggggtttccagaggggatgctgcccctcagggcggggggctctgtctgaaatggtaggataagtcctaagaagaaacttgtaaggagctaagaaggcaaacccaccacttcgtcttcctcaggagaaatcgcagatacagaaagatctatggagaattgaagatgtcactgcaggcctgagtgcaaataaagagaacttcagaattctagtggagtcagtaaaaaatccgggtgagatgttcatcttcctggatgtgggggatctgattgggggcagggtggtgggagggtggaaggctgggaaccaggtgggtgggatggcccttggggaggttgagtcttcgaggtgctaaattactccactcatcctccaaggaagggggtctttgttccatcccgtgctttgtttccttctatgccccttagagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttgtaagtagtgataactaggagctgaatgccattgtttcctctctgtcctcagattaccttctcctgggagagaaactcctgggaaaacttggggaaatggacccagccagcgtcctaaaggagtccttagtcacaagcagttaaaaagtagtatttccctgctattgtgccttagactgtcagaactggaagagccctggaagatgatctaacccaactctcccattttgcagttgggaaaactgaggcccaccaagaagaagtgagcgtgctgagtagggtggagtttgtgatctgcagagaggtgtgtggctgtggacgaagctgtccccatgcaaacctttgtgcaaatccgcagggggctctcctgcagttacacagcctgtgggcagtgagttcagtccagtggaaaagtgtccttcccttcacccgccgctgagcactgggctgggttgtgaggatgctttgatctttaaaataacctcgcagagtatacacagcaagagcagtatccccattccacagagaagaaaactaagagcctaaattgttgacatttgctcaatgtctccatgctaactagtgaatccaatcacatctcctggcccttctcttttattctgtgccatctgccatctaattgggctttcagtcccagatccggtctgtggcctctgtggctgactgggccagcaccttggtttgcctggcatagaaaggggccaagctcttggcagagtctgggaatgcaggagactttaaagaaataggagatgtggtcaggtcccaagagagctcacgcctccagggccaggccagccttggctggagaacacaatgaggctggtcccagtgcagggaagccatagaagagtggacctcggaatggggccctccagatttttgccaacaaaggcttggaggagacttacctgggcattgtgtgtgcctggacctctgatgaggtcagtgcacagtgctgggtaaaacacatgagttctgctgccctggtcttcaccatctacctgcttccagccatagtccagggcccagagctggacccaggatatggcccagcacccagccagagagtcactgtggatttcagcatcttgagatctccttcccaatcccagatccaagaggtggactggagctctagccctaaaacaggagagggaaaattccaaaacaaacagcaggaatgtctggggcagatggctgccaacatagggcagaatgctgccagctgggacagggcgtaggggaaaaaggcactggcataggagctgggacacccagattccgggactgattctctcactgtgtcctcaggcaagtccgtcccttccctgagcctcctcattttcccttttgtagatggtcacagaggctcctcctcagcttggtcatctgtggctctcaggcagggctttctcagcttgggtgagcatcaggatcaccaggagaggtcctctctcctaggaatatatgtgtgtttgccagttttaccatttgttttattacttacttgtttttaacacttataagatgggcgtggtgctgcttgcctgtcgtcccagctactgggaaggctaaggcaggaggatcatttgagcccaggagtttgaggctgcagtgacctgtgattacacaactgcactccagcctgggcaatacagcaagaccctgtctcaaaacaaaataaaacccatttatatttgtgaaacaataatatccatcctgaaaatgacataaaacaggattatataatttaacaaataacaataaagagaccacctgttttataccaacagctagactaagaaatagaacactgccagcaaccagaagcctgtgggttctttcccaggccaagctgcttcctgtctgccagaagtaaccacaatcttgactttttggataataatccccttgcctttttttttttttttaattttagtacctgtgttgactcctaaacactgtgattatgctggtatataattctatatactattttgtgtcttgcatcttttcttcaacattatgtttgtgagatttatatacattgttgcatgtggctatagttcttttatttttatttgacttattttcttgagtttaatgtctttttaaaaataaattagataatattctcaaaagatacaaaagcaaaagatataaaaaagtacataataacatgtctccttcccaccctctgcctccagacattccattcaatcaaaggcaatcaatgttttatgtttatctttctggggagctttttagaaattggtgattcggatatcttgtcaggattggaaactgtggatcctcagagaaccagtgcgtatcttaggcagatggcttaactttcacacatcagtgaagattgttgataaacctttgctttggagtgctctttcctgaactttccaagagcttggagtgccctttcctgaactctgcaaaattcttaaaaacaaaaccaaattagaccgagaaagagggaatttaggaggtggaaggcatgatggtcgttagtcctgcgagtgggtgttcatggcaaccaggggccggtctgttgatatgtagaggaaccacagccctcacagaacactgtggacagggagtttcaaggaaaatgttgcattcatcacattctagggaatgaactgcatggtaggcagtgagtcactcatcctgaccgcctgttctgtctgagtcaggaaggaggaaatattttgtaaccatgcacatttctgatagaaaggccaggaggatgtagactctgtccttgttcaggtccccaccttgctgaaggcgccagagctcgtgtagggccaatgagccggctcaggctgagcactgctgagtgggtagatgttactctccaggtaggtggtgctgtgataagcatggaagtcagggcagggttagcagcctgcctgcgatgtgcactccagatgagcggagggagcagttcagcacagcaccgagggcatggacccaggagacctgagtcctgggtttcaggacacagttatacaggtaacacttggaggaatagaaactgtatacctctgaggggatagaggagcagagcatgtcccttcttcactgctccgccaggggaagtgtgagtgctccttggctgaggcagtcatgttctgtggctctgatgtggcctgttcctaccctttaaacctccactgtggcagtacctagcagtcctccctccagctccgtctcgctgaccactggtctggttctctttctcagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtg

SEQ ID NO: 13159 - DNA, 3995 bp, Homo sapiens
caggagaaatcgcagatacagaaagatctatggagaattgaagatgtcactgcaggcctgagtgcaaataaagagaacttcagaattctagtggagtcagtaaaaaatccgggtgagatgttcatcttcctggatgtgggggatctgattgggggcagggtggtgggagggtggaaggctgggaaccaggtgggtgggatggcccttggggaggttgagtcttcgaggtgctaaattactccactcatcctccaaggaagggggtctttgttccatcccgtgctttgtttccttctatgccccttagagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttgtaagtagtgataactaggagctgaatgccattgtttcctctctgtcctcagattaccttctcctgggagagaaactcctgggaaaacttggggaaatggacccagccagcgtcctaaaggagtccttagtcacaagcagttaaaaagtagtatttccctgctattgtgccttagactgtcagaactggaagagccctggaagatgatctaacccaactctcccattttgcagttgggaaaactgaggcccaccaagaagaagtgagcgtgctgagtagggtggagtttgtgatctgcagagaggtgtgtggctgtggacgaagctgtccccatgcaaacctttgtgcaaatccgcagggggctctcctgcagttacacagcctgtgggcagtgagttcagtccagtggaaaagtgtccttcccttcacccgccgctgagcactgggctgggttgtgaggatgctttgatctttaaaataacctcgcagagtatacacagcaagagcagtatccccattccacagagaagaaaactaagagcctaaattgttgacatttgctcaatgtctccatgctaactagtgaatccaatcacatctcctggcccttctcttttattctgtgccatctgccatctaattgggctttcagtcccagatccggtctgtggcctctgtggctgactgggccagcaccttggtttgcctggcatagaaaggggccaagctcttggcagagtctgggaatgcaggagactttaaagaaataggagatgtggtcaggtcccaagagagctcacgcctccagggccaggccagccttggctggagaacacaatgaggctggtcccagtgcagggaagccatagaagagtggacctcggaatggggccctccagatttttgccaacaaaggcttggaggagacttacctgggcattgtgtgtgcctggacctctgatgaggtcagtgcacagtgctgggtaaaacacatgagttctgctgccctggtcttcaccatctacctgcttccagccatagtccagggcccagagctggacccaggatatggcccagcacccagccagagagtcactgtggatttcagcatcttgagatctccttcccaatcccagatccaagaggtggactggagctctagccctaaaacaggagagggaaaattccaaaacaaacagcaggaatgtctggggcagatggctgccaacatagggcagaatgctgccagctgggacagggcgtaggggaaaaaggcactggcataggagctgggacacccagattccgggactgattctctcactgtgtcctcaggcaagtccgtcccttccctgagcctcctcattttcccttttgtagatggtcacagaggctcctcctcagcttggtcatctgtggctctcaggcagggctttctcagcttgggtgagcatcaggatcaccaggagaggtcctctctcctaggaatatatgtgtgtttgccagttttaccatttgttttattacttacttgtttttaacacttataagatgggcgtggtgctgcttgcctgtcgtcccagctactgggaaggctaaggcaggaggatcatttgagcccaggagtttgaggctgcagtgacctgtgattacacaactgcactccagcctgggcaatacagcaagaccctgtctcaaaacaaaataaaacccatttatatttgtgaaacaataatatccatcctgaaaatgacataaaacaggattatataatttaacaaataacaataaagagaccacctgttttataccaacagctagactaagaaatagaacactgccagcaaccagaagcctgtgggttctttcccaggccaagctgcttcctgtctgccagaagtaaccacaatcttgactttttggataataatccccttgcctttttttttttttttaattttagtacctgtgttgactcctaaacactgtgattatgctggtatataattctatatactattttgtgtcttgcatcttttcttcaacattatgtttgtgagatttatatacattgttgcatgtggctatagttcttttatttttatttgacttattttcttgagtttaatgtctttttaaaaataaattagataatattctcaaaagatacaaaagcaaaagatataaaaaagtacataataacatgtctccttcccaccctctgcctccagacattccattcaatcaaaggcaatcaatgttttatgtttatctttctggggagctttttagaaattggtgattcggatatcttgtcaggattggaaactgtggatcctcagagaaccagtgcgtatcttaggcagatggcttaactttcacacatcagtgaagattgttgataaacctttgctttggagtgctctttcctgaactttccaagagcttggagtgccctttcctgaactctgcaaaattcttaaaaacaaaaccaaattagaccgagaaagagggaatttaggaggtggaaggcatgatggtcgttagtcctgcgagtgggtgttcatggcaaccaggggccggtctgttgatatgtagaggaaccacagccctcacagaacactgtggacagggagtttcaaggaaaatgttgcattcatcacattctagggaatgaactgcatggtaggcagtgagtcactcatcctgaccgcctgttctgtctgagtcaggaaggaggaaatattttgtaaccatgcacatttctgatagaaaggccaggaggatgtagactctgtccttgttcaggtccccaccttgctgaaggcgccagagctcgtgtagggccaatgagccggctcaggctgagcactgctgagtgggtagatgttactctccaggtaggtggtgctgtgataagcatggaagtcagggcagggttagcagcctgcctgcgatgtgcactccagatgagcggagggagcagttcagcacagcaccgagggcatggacccaggagacctgagtcctgggtttcaggacacagttatacaggtaacacttggaggaatagaaactgtatacctctgaggggatagaggagcagagcatgtcccttcttcactgctccgccaggggaagtgtgagtgctccttggctgaggcagtcatgttctgtggctctgatgtggcctgttcctaccctttaaacctccactgtggcagtacctagcagtcctccctccagctccgtctcgctgaccactggtctggttctctttctcagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgt

SEQ ID NO: 13160 - DNA, 349 bp, Homo sapiens; identical to SEQ ID NO: 13157

SEQ ID NO: 13161 - DNA, 3612 bp, Homo sapiens
ttttttgatagcattttttgatagtagccatcctaatgggtgtgaggtgctgccatcatttctttttgaaatcaagtgtccagtgcatgtggtctgaaaacttaataggattctaaagtgtccacatcacacctgaaatgtttgcgtaggtctgtactgtcaggcaaacgtgtgcactcacacatcactctcacctctgtctgtgcccggagcatgattccagttggttcttggtgtcgaggttgtcagtgacggtgacctggtacctggtgagaccccatttgccggaagcatgtgtgcactgctcccttgggaagatagaggcctctgaatgtgtttgtttcttggcttcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaaggtaggattcccatctcaagtcccagtatcacagccaataaacagccctgtgacatttttgtggaggcagagctgagggaaaggacctcttttctgcctgagttcccaggaaagaaattggggagtcatttctgcctcagtccttcccaacaccctctgagtttctccctgctcaaaatggatcaggtggacagcctccacttgcaggcctgaatgcgagaggagtccacgccactgcctgtgggaagttgccagccagggaggatgttactgggaatgaaatctctggccaggtgcggaggctcatgcctataatcccaacactttgggaaaccaaggcaggaggatctcatgaggccagaagtttgaaaccagcctgggcaacatagtgaggccctaactctataaaaaaataaaataaattagctggatgtggtggcatgtgcctgtagtcccagctgttctggaggctgagctaggaggatcgcttgagcccaggaagttgaggctacagtaagatatgatcgtgccactgtactccagcctgggcaacagagaaagaccctgtctctaaaaaacaaaaaaaggaatctcaagtctgcactttgtgttctttatacacaactctggcagattccatgctgcccctctaataacactgcgtttgcttgcatgccacagtgctttcctgagtgagcaataaagaggtgttagtgacacctcaggtgctcagagctgtcctttccaaccctgagcttgtcgtgtaattgagaggttgtcacctgcttggaggtgggagcatctgtgggaaggttcaggctgtgtccttatcactaaacgaggaggggaggaaggagctgcaccaggctgctagcaacaaagcagggcttgtggttgctatttttaaaaggttgcttttttttccccctaagtttgagcatctttgtaaaatggtgtcagccctatcataccaaataaagagggatagcctcgatcccaggtgactcctccaggatggcgttccaggcttcagtcccattactataaaaatgttactgttaacccagaaagtcctggaagactttagccctccttttgggtagcaaggtttgctcaggaatacaggccctttgagaaacttaattgaaagcaagcaatctttacttgactccaccctgaagctcatcgtgttatacacggaagtggccccctggagggaccttcagaagcaattctccacaaaagctgggatttgtatttagtttattcactcacatttttcttgcttgcagcctaacttattttagatgcctgatgtatgggcccataggaatgtgtgagaatgccaaccagaataggtgtttgacaccaaaacttttagaaacccgaaaaccttttgataaaagcaaaattccagcctttgttgaatatttttctttcaatcccaacgagtcagcatcaccaaataaaactccttaggagcactccgagctgtagttttatttgttgcctgcaggcactcccagctgtattctgggctcagtgtttctacaccagatggtctgtgttgcgtggccacacctgcagcatatcggtgtgactgccacccagatcaacaggttgaactcttctccgcctgacagtgctttgatgactactgccgtcagatgggtgggtctgtaggtgggattgtttttggaaaagaaagccttgtctagttagagtgtggccagtgttttctgggtgggtttctggatcccacgcctactccctggagtcatggaactctcctttctcctttgcagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctgggcgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtctta

SEQ ID NO: 13162 - DNA, 3614 bp, Homo sapiens
ttttttgatagcattttttgatagtagccatcctaatgggtgtgaggtgctgccatcatttctttttgaaatcaagtgtccagtgcatgtggtctgaaaacttaataggattctaaagtgtccacatcacacctgaaatgtttgcataggtctgtactgtcaggcaaacgtgtgcactcacacatcactctcacctctgtctgtgcccggagcatgattccagttggttcttggtgtcgaggttgtcagtgatggtgatctggtgcctggtgagaccccatttgccggaagcatgtgtgcactgctcccttgggaagatagaggcctctgaatgtgtttgtttcttggcttcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaaggtaggattcccatctcaagtcccagtatcacagccaataaacagccctgtgacatttttgtggaggcagagctgagggaaaggacctcttttctgcctgagttcccaggaaagaaattggggagtcatttctgcctcagtccttcccaacgccctctgagtttctccctgctcaaaatggatcaggtggacagcctccacttgcaggcctgaatgcgagaggagtccacgccactgcctgtgggaagttgccagccagggaggatgttactgggaatgaaatctctggccaggtgcggaggctcatgcctgtaatcccaacactttgggaaaccaaggcaggaggatctcatgaggccagaagtttgaaaccagcctgggcaacatagtgaggccctaactctataaaaaaataaaataaattagctggatgtggtggcatgtgcctgtagtcccagctgttctggaggctgagctaggaggatcgcttgagcccaggaagttgaggctacagtaagatatgatcatgccactgtactccagcctgggcaacagagaaagaccctgtctctaaaaaacaaaaaaagaaatctcaagtctgcactttgtgttctttatacacaactctggcagattccatgctgcccctctaataacactgcgtttgcttgcatgccacagtgctttcctgagtgagcaataaagaggtgttagtgacacctcaggtgctcagagctgtcctttccaaccctgagcttgtcgtgtaattgagaggttgtcacctgcttggaggtgggagcatctgtgggaaggttcaggctgtgtccttatcactaaacgaggaggggaggaaggagctgcaccaggctgctagcaacaaagcagggcttgtggttgctatttttaaaaggttgctttttttttccccctaagtttgagcatctttgtaaaatggtgtcagccctatcataccaaataaagagggatagcctcgatcccaggtgactcctccaggatggcgttccagggttcagtcccattactataaaaatgtttctgttaacccagaaagtcctggaagactttagccctccttttgggtagcaaggtttgctccaggaatacaggccctttgagaaacttaattgaaagcaagcaatctttacttgactccaccctgaagctcatcgtgttatacacggaagtggccccctggagggaccttcagaagcaattctccacaaaagctgggatttgtatttaatttattcactcacatttttcttgcttgcagcctaacttattttagatgcctgatgtatgggcccataggaatgtgtgagaatgccaaccagaataggtgtttgacaccaaaacttttagaaacccgaaaaccttttgataaaagcaaaattccagcctttgttgaatatttttctttcaatcccaacgagtcagcatcaccaaataaaactccttaggagcactccgagctgtagttttatttgttgcctgcaggcactcccagctgtattctgggctcagtgtttctacaccagatggtctgtgttgcatggccacacctgcagcatatcggtgtgactgccacccagatcaacaggttgaactcttctccgcctgacagtgctttgatgactactgctgtcagatgggtgggtctgtaggtgggattgtttttggaaaagaaagccttgtctagttagagtgtggccagtgttttctgggtgggtttctggatcccacgcctactccctggagtcatggaactctcctttctcctttgcagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtctta

SEQ ID NO: 13163 - DNA, 3613 bp, Homo sapiens
ttttttgatagcattttttgatagtagccatcctaatgggtgtgaggtgctgccatcatttctttttgaaatcaagtgtccagtgcatgtggtctgaaaacttaataggattctaaagtgtccacatcacacctgaaatgtttgcgtaggtctgtactgtcaggcaaacgtgtgcactcacacatcactctcacctctgtctgtgcccggagcatgattccagttggttcttggtgtcgaggttgtcagtgacggtgacctggtacctggtgagaccccatttgccggaagcatgtgtgcactgctcccttgggaagatagaggcctctgaatgtgtttgtttcttggcttcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaaggtaggattcccatctcaagtcccagtatcacagccaataaacagccctgtgacatttttgtggaggcagagctgagggaaaggacctcttttctgcctgagttcccaggaaagaaattggggagtcatttctgcctcagtccttcccaacaccctctgagtttctccctgctcaaaatggatcaggtggacagcctccacttgcaggcctgaatgcgagaggagtccacgccactgcctgtgggaagttgccagccagggaggatgttactgggaatgaaatctctggccaggtgcggaggctcatgcctataatcccaacactttgggaaaccaaggcaggaggatctcatgaggccagaagtttgaaaccagcctgggcaacatagtgaggccctaactctataaaaaaataaaataaattagctggatgtggtggcatgtgcctgtagtcccagctgttctggaggctgagctaggaggatcgcttgagcccaggaagttgaggctacagtaagatatgatcgtgccactgtactccagcctgggcaacagagaaagaccctgtctctaaaaaacaaaaaaaggaatctcaagtctgcactttgtgttctttatacacaactctggcagattccatgctgcccctctaataacactgcgtttgcttgcatgccacagtgctttcctgagtgagcaataaagaggtgttagtgacacctcaggtgctcagagctgtcctttccaaccctgagcttgtcgtgtaattgagaggttgtcacctgcttggaggtgggagcatctgtgggaaggttcaggctgtgtccttatcactaaacgaggaggggaggaaggagctgcaccaggctgctagcaacaaagcagggcttgtggttgctatttttaaaaggttgcttttttttccccctaagtttgagcatctttgtaaaatggtgtcagccctatcataccaaataaagagggatagcctcgatcccaggtgactcctccaggatggcgttccagggttcagtcccattactataaaaatgtttctgttaacccagaaagtcctggaagactttagccctccttttgggtagcaaggtttgctccaggaatacaggccctttgagaaacttaattgaaagcaagcaatctttacttgactccaccctgaagctcatcgtgttatacacggaagtggccccctggagggaccttcagaagcaattctccacaaaagctgggatttgtatttagtttattcactcacatttttcttgcttgcagcctaacttattttagatgcctgatgtatgggcccataggaatgtgtgagaatgccaaccagaataggtgtttgacaccaaaacttttagaaacccgaaaaccttttgataaaagcaaaattccagcctttgttgaatatttttctttcaatcccaacgagtcagcatcaccaaataaaactccttaggagcactccgagctgtagttttatttgttgcctgcaggcactcccagctgtattctgggctcagtgtttctacaccagatggtctgtgttgcgtggccacacctgcagcatatcggtgtgactgccacccagatcaacaggttgaactcttctccgcctgacagtgctttgatgactactgccgtcagatgggtgggtctgtaggtgggattgtttttggaaaagaaagccttgtctagttagagtgtggccagtgttttctgggtgggtttctggatcccacgcctactccctggagtcatggaactctcctttctcctttgcagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctgggcgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtctta

SEQ ID NO: 13164 - DNA, 923 bp, Homo sapiens
tctcagtagacaggatcattaggaaaatagcaacatcaatcctgttacacaggagcagtgacacaggggtggctgcagtgtggtacatgccacacaaatgatagagaaagtgcccgttcattgcagtttcctcttcctgggggacctgagccctgactcactgtcttattaggggcaggcggaagaagctgcactctggcatccatgccaccttctaagatgaacatgcggagacagaacttcagctgctcagagagagtgcagtgggcatggtctgccctgggggcttgctccattacaccctgacttggcatgcaaccgagtctttgtgtaaagccatcctgtcattgcacatactggctcactcagtgtctttcctgctgctgatgtggctctgtgctggcagtttcagggtcagtgtgctgctttcctagggacattagaagggcgcaggagtacatgtctgcccattcctttggagtatcgcagatgatgctatacgataccaagtgttaccgctcacagagactgaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcctgggcaacagagcgagactccatctcaaaaaaaaaaaaa

SEQ ID NO: 13165 - DNA, 138 bp, Homo sapiens
gctagagaacaagtgtgtgcctgcccagtcagtgggtgcccctcagccttggccacaggacagatgtgaggccatgaactgatggcatgggagcacggggctggggtggcccagccgtccccagaacactgagctacc

SEQ ID NO: 13166 - DNA, 924 bp, Homo sapiens
tctcagtagacaggatcattaggaaaatagcaacatcaatcctgttacacaggagcagtgacacgggtggctgcagtgtggtacatgccacacaaatgatagagaaagtgcccgttcattgcagtttcctcttcctgggggacctgagccctgactcactgtcttattaggggcaggcggaagaagctgcactctggcatccatgccaccttctaagatgaacatgcagagacagaacttcagctgctcagagagagtgcagtgggcatggtctgccctgggggcttgctccattacaccctgacttggcatgcaaccgagtctttgtgtaaagccatcctgtcattgcacatactggctcactcagtgtctttcctgctgctgatgtggctctgtgctggcagtttcagggtcagtgtgctgctttcctagggacattagaagggcgcaggagtgcatgtctgcccattcctttggagtatcgcagatgatgctatacgataccaagtgttaccgctcacagagactgggaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcctgggcaacagagcgagactccatctcaaaaaaaaaaaaaa

SEQ ID NO: 13167 - DNA, 925 bp, Homo sapiens
tctcagtagacaggatcattaggaaaatagcaacatcaatcctgttacacaggagcagtgacacaggggtggctgcagtgtggtacatgccacacaaatgatagagaaagtgcccgttcattgcagtttcctcttcctgggggacctgagccctgactcactgtcttattaggggcaggcggaagaagctgcactctggcatccatgccaccttctaagatgaacatgcggagacagaacttcagctgctcagagagagtgcagtgggcatggtctgccctgggggcttgctccattacaccctgacttggcatgcaaccgagtctttgtgtaaagccatcctgtcattgcacatactggctcactcagtgtctttcctgctgctgatgtggctctgtgctggcagtttcagggtcagtgtgctgctttcctagggacattagaagggcgcaggagtacatgtctgcccattcctttggagtatcgcagatgatgctatacgataccaagtgttaccgctcacagagactgggaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcctgggcaacagagcgagactccatctcaaaaaaaaaaaaa

SEQ ID NO: 13168 - DNA, 138 bp, Homo sapiens; identical to SEQ ID NO: 13165

SEQ ID NO: 13169 - DNA, 8793 bp, Homo sapiens
tttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaaggtaggggcactgcgccaccactgcccggggggcgcgggtgtggtgtcccgcgggggagcgggagccgggtccttaccatcgactcacccagtttctccgggctgcacctgcgacccctccgcccccgctcccattccctcgccggagggaagccgcgagttgcgagtcgtgatagaaacttaaatcgggggttgcgctgggtggtccctgctgtgcctgctattgcgctcctggcttcttaagaacattctcaaggggctcctaccgcggtggtttttatgtaagatcaggaatcagtttcctgattacagatgggaatactgaagcgttagcgcggcaggtgacttggagaaggtggcccagttggaaagaaagaaattgcaacccagtgtatttgttttccagtaacatcccctccaggatatcccactagttgagaaatgtttgggttactctcccaaatattcccaaggttatttcccgagcctgggagcgcaacaaatacataaataggcgctcgttgaatttttctcgtctagccaactatcagtgtactctggggccttcaaaacattctgccgtttgtctcggggagatggggttaggaagaatgaatatgggagaaaatgacagtttccttcgcggaaatcaaagcgcagatgcagttcccgggtgtctctgcatggaaacagtcgaagctgctgccggaagctctgctggcctggacaaggccacccagaataaagtcacagaagttactgtgtcctggccaaaggccacgggccccatctgatttattgtctatttatctgtgttgcccaatgccgtcttacacctgaagccattcagtctccatgcctgggagcttaggtttatcatcctctttaaaggtatgtcagcagcttctggagcagaatacaggaaggggtaaaactataaagttgggtctttcaggcttagagccctgctaggacgattcatctctgctttgggtcccagttgagcacaaagaagccatcacgtccctctccattggtgaactgatactgcagaaacctcagctcaaggactaggacttgaagatattttgggggcactcattatgcgtcaggcattgtgctgagcagtagagatgcgaaaatgaatacagtgcagccctgccctagagaagggcacagcctcccagggagacactgacatagctggctccccccgcccccgggggggcttcagggcacagagctcaggcagttcactcctcagcggtgagcttgtaaactcagggaagttttcaaatcacggtgacatgaaaactgggcacagaaggatgagttaagatttcaccagataacagtgaagtggtatgaagtaggcacacttcatccccactagaacggctactccaaaaaatgtccaaacaaaccgaataacaaatgttggcgagaatgtagagaaattggaaccattgtacattgctggtgggaatgtaaaatgggacagctgctgtggaaaacaatttgggagttccttaaaaagttcagtgtagacttattctgtgatctagcagttccactcctagggatgtaaccaaagaattgaaaacaggtactcaaatcaatgtttatatacacattttaatggaagtattatttacaatagtcaaaaggtggaaacaacccgaatgtccctaagtggatgaatgcataaacaagtgtgttatatacatacaatgggaatagtattcagccataaaaggaaggaaatgtactaatccatgctacaatatgatgaacctctaaaatattatgctaagtgaagtaagcaagacccgcaagatcacatattgtgcgtatgattccatttgtatggaatgcttaggataggtcaacccatggagatggaacacagattggtggttgccagggactgcgggaaagaggaatggagcccatctgcttaatggggaatgtgttttttcctggggatgatgaaaatgttttggaactagatagaagtggtggttgcacaacaatgtaaatgtactaaatgccaccgggctgtacgcactttaaaatggtgaattttatgttatgtgaattttgccttaactaaaacaaacaaaaaaaacaagatttcagtggatagagaagtggtgtcatctcaggtagaggggccatcacaagcccagctgtgggcatgaaagctctagagtgttgcacgctagttcaatggacccaggaggccaggtgagaggatgtcgtcaggttagggttggatctctcctttctgcccttcaaaagtgacttcagcttctactttcttggagccacctgagagggtcaccaggctcaaacatggagatataaagcaggtgacccctctttgttccccgagaccccagctcccctctgagagagtagttgggtagaaagctctactcagatcaaagaattccaaatgcactctcttaaatgacactgaaatagtggttgagagatattttatgtttctttgcatttcatttctcaaatctgtgtttttaacagtgttccagttaatgaactattttagtagattttttttccctaaattacaaagtgacaagtagcttttaaagtataacaggctgagcaaaatggatgtacaaataccaaaaatgtcacgtttaatgcaggcgattgtcattctgatcttgtttataatggatcactcttgattgttaagcttgttcccagagaatatgtttttcttttgttgtttcaaacatgtaagtaaaattcccccagtgattcttatcacacatttaaagaactgtatctcttagcaacatcacatacccacacatgcgcatgccccagcccagtgtctctttgagacatcaacagggtaatgtccaggaaagcagtgtctagagaagacacagacattacttggttcttgcaaagctcctcatttagcgggagaggtaccaaaggaaacactcagcctctttctacatgctcaggatacagtaatgagcacaacagagtccctgccctccttctgttactgtgagggaccctgtaatttaaactattgaaagctcagctgggtgtggtggctcaggcatgtaatcccagcactttgggaggctgaggcgggtggatcacctgaggtcaggagctggaaaccagactgacgaacatggtgaaccctgtctctactaaaaatacaaaaagattagcctggcgcggtggtgcatgcctataatcccagctacttgggaggctgcagcaggagaatcgcttgaacctgggaggtggaggttgcagtgagctgagatcgcgccattgcactccagactgggcaacaagagcaaaacgcggtctcaaaaaaaaaaaaaaaaaaaaaagctcaagtaagccagaagtcataggaaattatagtcttaagaaactttcccaaacagacaacaaaaatattgggtttatctatcaccaccacaaacctaaattgctatgtaatcaaaagaagcagatgttatttagcagtaataatagctgacattggggggcacttatactgcctgcagtttgtgccaggccctgttctcagtgctttgcttacatgatctcatttactcctcttaacaacccaatgaggtggttactaaatattcccattgtataggtgaggaaaccgaggccatgggaaattaagtaagtgatagagttggaattcaagcccagggcatgagtggttaactagaagcttacatattgcctttatttaaaaagggaaacatagtatgggggttaaggtcataggccctgaagtgagatttctttgggattgaacttcagctctgcctctaaccagatatatacatgtggacagatgtaatctctctgtgctttgaatgattgaagtctgatagacaaaggccaccagggacatgccagtagccaatccacgttaggtttatgtgcttagggctacaagggagagtgcatgccagaggaattgtggggtcttcaaaaagtggagatctcaagtaacgaattgaatatttgagtctgaactaaagagttcttcaaatctaggagatacttgtagtcattagaaatggatgagaccatctaaggagagactgtagggaaagaaagagagaaggaaagacccaggactgagtattgaacaacaccaacattttaaagtctggtagaagggataatttagcaaagaaagctgaggaggagctccctatttaggtaggggagaactaagaatatggagtcaaagacgccacatgattatttcataaagtatgtcaaaagctgctgagaggtcagggagagaaagacagaaaagcgtccactgggtcaggcagcatgggggttgtagatggccatgaccagacagtccctcatgggttggggtaggagccggagtcagagggaataagaagcgcagacgtggaggcagtatatgtggttggctcttttggctggcttggcacgatggagggcagagactggggcaggatatggagtcacggtgatacccgagcatgtatgtaagctaatgggatccagtggagaggaagcgaatgatggaggtggtgaagggaaagccaagatcaaggtgggagaaggcactgacaccaagtatcaagggaatggcttgggggaagaagaccactttctccaccgtaacacaggcaatgcgggagaagccaggggcagccacaggcagggctgttgagagtggtggaaggtgaacgtgttccctgacgatgtctgggtttttttttttttttttttttttctgtgaaaggtgaagtgggatcatctcatgaaggtatggagacttgggtgtgttcgtgtgtgttgcaagtggggaggcttaagaagggaaaaggtatgaggcagtacccgggggagagagaaattcatcctactggacagatgtggaggtttgtcaggtggtgttggaagtcaaggtgagatatgtgattgtgatcaggaattttaagttaaaccagtctgagtggttatggtaatatggaaaagtcaaaggactgagagacaaggtatgtggcctaaggcacaggttatctgcatggacattgatatcaccaagagtgatgacagaagttgaggtacggaggggaagaccatgggcagccgtgcaataaatgtttggtggtggtggtggtaatttttctgttgcaatcacatttgagtcctttagatgtcccctgtctagcacctgacattccctgaatgtcccctacccagccttgtagaaaaggaagaggaggagtggttaccaagaaagcattgcccaagcctgaccatcagggagcttataatggtattggaaatgctggacttacatagatatagcaattagaaaatggcagaagactacaaaaggacagatgtgtgggtcagacagaaatatgccattgaggtagaaggaggagaagatgggctttcagataaggtgaaggaaggaaaacttaacccagccttctgacggtccagtaatttttagctggaacagagaagaggagtgatctttggtttaaaaaacaaaataaaactgctttagttttagaattagcagccttactgctgtttccaagaaggtctttgaattatctggaaataagctgtgcttgaaagcactttgcaaggtgatgatgtctgctgtgagccgctacatattcttaggctggaggtgggcaccttccaccagagatgtgggaatgtggtaacttgctgatttgtcacaagagaatcaggaaaaatgatctttatatatgtcgccgtgactcattttttttcatgaaagatggtagaattaaaaagttgcctaccctaatcctttgcttttctcttttattcctaacactagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacgttggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgacctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaatgtt

SEQ ID NO: 13170 - DNA, 2523 bp, Homo sapiens
cgggaaggtcatcatcaaaggatgccgctacgtggtcatcggcctgcaagcgttgcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggacagacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagccagggtaggggacagagctgctggggcctttccttgcctgggaatctgtcccggaagagcttccccactcccatccccaaattggaaaaccgtacattcagcctgtttggccctgaaattcctcagatctggctaagattactcactatgtcgcagtaaccctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaa

SEQ ID NO: 13171 - DNA, 2548 bp, Homo sapiens
agaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaatgtt

SEQ ID NO: 13172 - DNA, 116 bp, Homo sapiens
gctaatttttgtatttttagtagagacagggtttcactatattggccaggctggtctcgaactcctgacctcaggtgatccaccgccttggtctcccaaagtgttgggattacagg

SEQ ID NO: 13173 - DNA, 2846 bp, Homo sapiens; identical to SEQ ID NO: 9550

SEQ ID NO: 13174 - DNA, 857 bp, Homo sapiens; identical to SEQ ID NO: 9551

SEQ ID NO: 13175 - DNA, 11445 bp, Homo sapiens; identical to SEQ ID NO: 6842

SEQ ID NO: 13176 - DNA, 535 bp, Homo sapiens; identical to SEQ ID NO: 6843

SEQ ID NO: 13177 - DNA, 197 bp, Homo sapiens; identical to SEQ ID NO: 6844

SEQ ID NO: 13178 - DNA, 3802 bp, Homo sapiens
attgagtggggtccatctcggacataggctccaaatggaaaagaagctgatgcttggcgactcctctctggccctggtctggctgggcctctgcctgcctccctggggcaagcctgggactccactccttcctgcgctgccccggcccctttctcttgggggttggtagcatctgctgtcctgggtagaggtccttaaggacactgcttgcgtgctggttttcaacccccaagctgtctttgtgggtcacacagtatcactcaaataataggttacttgagaagttcggtactcccttttaattgttgtcgatacgtagtttacttaagatatgtaaaatattttcttattttcttttaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataaaaatgttataaaacagtgtagtacagcaactgtttctatgatgtaatctagagatgatctaaatatttgagaggttttgcataggtcatgtgcaaatagcctgttctctctttaatgagaacccagttttataaactagagctcttcctgtagaaagctaccagcatggatgcagcagcccttttcagctgggttggagcttcataggcccccagaggcagaggcgactgcaactttgtgcccttctgggcaaaggctagtgcgagcccctcagactacatctttactagaaactccaagtgttgcatgaaaacgagagcttgaccctcttttgagatgacagtcatatttcttgcaaatattttggcttgcacaagcagaaaacttcttctaaatgtaaaatttccaatgagaacgaataaaccattttaactgatgtggtttaataattgctctaccatatatatttgtaagcagcattctctgctttgcccttaatctttgaggtcagcattgcctcctggatcagagcggttccttgtgacttgcctggggtcacctggctggtgaaggaagcccccctttctgtttaccaccatctctagtgcccccctcacacagcagcctccagagtttgcaccctgacttggagtcgctgctggtgccctgattgagttgagctgtgtcctttaacaatggggtcacttcaggtgagcatagaagtgatgtgtcccttatctccaaggcttccgtggagtgccctggggggtgtgggtcatgtttacagagcgtggaggccacggccaggcagcatctttagctggacaggaaaatgagaagtgacagcatttagagggaagcaaaaagaacaacacaggttacaggttgcaagtaattttccattttgtattttcgttctttttcttttttttgagactgagtcttgctcgcccaggctggagtgcagtggtgcgatctcggcttactgcaacctccacctcctggattcaagcaattctcctgcctcagcctcccaagtatctgggattacaggcgcctgccaccatgcccagctaatttttgtatttttaatagagatggggtttcaccatgttggccaggctggtctcgaactcctaacctcaagtggtctgcctgcctcggcctcccgaagtgctgggattatgggcttgagccaccaggcccggccccattttgtatattttttaaggctttcattttatgccagtccttcccccaggatggaacatggcataaaatcagagtcatcattagcattgaaatgtaattaaagcttggacagcttggaaaagaattctcaaagtatctactgtctttttcagatttttgtcatttcaacaagagtaaaagtttcataaataagattctttagtaatgtattagaatgaaagtgaaaaataatacagaaaaaaaaatatactggcctggcacagtggctaactccagcctggggacagagcaagactccgtctcaaaaaaaaaaaaaaagaaatataccttaaagtgatcgccttgaccatgttttctaagtgtcccagttgtcttgctgctaacaatatctccaaagctcagtagactaaaacaaggtttatttcataccacacaatctgttgggtcaggagttaggcagttctctcacattgtgcccgtgagggtcattcacttggcagcagggctggtatggagggtcccagatagtgatagcatccttcctggccccagcccctggttggggagctgaaagtcgggactcagcttcttcatatcctcttttcagcatggtggtggccagcccatacttgcaaaagtccagaacagacttgggtccctttgcaggccacacccaaactggcacagcgtcttgttcactgtgcttgtggtcagagcagcccatctgcctgcggaggtgctggggagctcgtgccacctccgagctgctcgcgtccttgctcacgtccttactcacatccttaccctgctatactgtccaatatttcctatttgtccctactgtctggcttgtgaagccttgtcctgagcagttaaatgatgaaattgtacatttgatttgttagctgtatttttgtctaaacgttagttgtttaactatattaaaattatctttacaaatcatcttgaatcatctcacatagcacacattaggaaacactggtcagaaggacttgctttatgtagagctccactgtttgtagggaggtggcccctgctgcgcgtgtttggcggcaatgtcaccttttgttctgtggtcagttggtcactatgtgcttacactttaccgctaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaag

SEQ ID NO: 13179 - DNA, 15769 bp, Homo sapiens
ttttgagacgaaatttcactcttgttgcctaggctggagtgcaatggcatgctatcagctcactgcaacctctgccttgcaggttgaagcgattctcctgcctcagcctcccaagtagctggcattacaggcatgcgccaacaagcccggctagtttttttgtatttttagtagagacgggatttctccatgtggtcaggctggtctcgaactcctgacctcaggtgatcctcccgcctctgcctcccaaagtgctgggattacaggcctgagccactgtgcccggcctaattttgtatttttagtagagaaggggtttattcgtgttggtcaggctgatcttgaactcccgaccgcaggggatccacccgcctcatccacccaaactgctgggactacaggcatgagccaccaagcccggccgtttttagcgtttaaaaggattgcagcttggctggtggcagtccctctgtcctggcacagacgcagggggagaccctgtgtcttcagacagcatggacttcaggaccctactgagagatggaatcaagagctctccggggttctttgagtggggagttgtatcggaaaccaccatcagcgcgcctgagctcgcctcgcattgttcttctgtagtgcggggggccactgccaccaccgtgaggacacgttggggtctggggagggattgttatggctgtgggtgcaccttgcacgtcttgccgacctagctttgcacgctgatcttccctccgtgcccgcttacattgttaactgggtttctgccctccctcctctccttcgtatttctgtgtctcattgacaactgttctgtagtcgctttgttgacagttgccaaactgctttccaaaaacatttccactgcaatcccggtttttggtgccagccgcagtggtgtgagtgcgctcgctttattatagtcttgccagcactgggcgtctctgtgtattgtaaacacatgcgatcatcactcttatctctccatcccccccacaattaaagatgtgccgtgctatctctgctcaggttaccttggccttgggatgagttggctggaggctcaggcagcgcgagggacaggaggagggcgaggcgctgcctggtggattagcggggagccatggcacgggcaggactcaggagaggaggccggcagctcacagcagaccgcggggctcagctggcctgccctgtgcttggggtttgtttttgagcgttgaaatgaggtccttaaaccttagtccgtgcattgagagcaaggcagctgccttgagccttacttccttttcctctttgtcgcctagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggtgagtatttgctgctgctgtgtgtcaaacgtacgtgatttccttggggaggctcaccttcctcggggcttgccggagactccaagcaaggctggtgtccttccaggcaggaggtctcaggccccttgaggggtgtcacctgttgtgaaggccacttgagtctttgggggctgggtaccccccaagcagatgacgtgatgagtgtggctaaatatttaacctggttttgtagatgagaacgttagacacatctcttgatggtctgcggaggttttttctgatgtagttaatttcattttaacctggcatcagcaagttacattctgtgtccttgtgtctcactggcagggccctgggaagctgttctttttcttagattgaaagttagtatctctccagggtttttggggacatttattgacctcttcttatttctctgttttgtttttttgaatacataaaacagtacgctctggacatttgctggagacacagcctccagagtcttgtgttccgagtttcacaaacaggagtattgtcgcagtactgtcaagtcacacttgttacctgtcttcggggtgttttttcctctgaaagcaaagaaatgaaggtcgaaagcagctgacatgggacgttttgctgacgtgggacccatgaagccgtgtgtggttgtggatttagtgaaggttgtaacaggttcaggggaggcctgagcaactcggggtgtactgtctccatctgggcctctaaagagacagagtcccgtgccgccactgtggtcgccaaggtggccgccgtgtgcgtgctagggccattccagggagccctgggggcacctcactctggagggcctgggtgagttcctgaataattctttcttgcctgacctttgtgaagaaaccgtaggtgaggtttattttccttttttctcttttttacacataggaaatatttcacaatgcaaagaaaaacatgaaatatagcttacccatattcccaacatattgttttaattaatgttaacttttgctgcccttacactttagattttttaaattgcaggttttatgaaataatttttttataaaaggattatgccctcatgaaaaatgccttcaaccatgagactagtccccaaagttttggggactcagatcctttcagaaagaagaaactctttggaaaaccttgggcattctgcatggctgcttacaaccacccagtgaaagaacaggcctcctcttttctcagctttacctgttttttgagacagagtcttgctctgtcacccaggcttgagtgcagtggcatgatcatagctcactgcagcctcgacttcctgggctcaagtgatcctcttacctcagcctcccaagtagctgcagttacaggaatgcaccaccgtgcccagctaattgtaaaattttttgtagagacagggtctcactttgttgcccagactggtcttgaactcctaggctcgagtgattctctcctcagccttgcaaagtgttgggattacaggcgtgagccactgtgcttggcctcagttttacttccttgtatgtctctttttaatttaactttattttattatgtatgtatttatccttttagaaacagagtcttgctctgtcacctaggctggagtgcagcggtgtgatcatagctcactgcagccttcaccacctgggcttaagcgatcctcctgccttagcctcctgagtagctgggaccacaggcatgtgccaccatacatggcccttaacatttatcttgactgaaaaaggaagactcatctgtgaaattgcctgtttccctgggttctggagatgggtggagagcaggcactgtccctccaggggctgtggtccgtgtctttctgaacctgcaccagggaggtgcccgggagagcacggtgagctggaggctcctccatggggctgtttggaatccacagtactgggtctcagattacatgtgttaccctcagttctttctcagctttcctgaaatggagatcacataaaagttgatttccaggggagggggaaaggacagtgataggaggctgggcaagagccagctgcagcaccggagagccgggaggccccctgaggacggtcacaacctccagggagggacacgtcacgcgccattctctggaagaggatccttccttcttgtaggaaacctgcttgtgaagtgttgagtttagacaacggaaagatcacatcagtatccccttagaaagggttccactaaatatcggtgctcgttcacaattctttcttcctcttttctacttatgaagctagcacgtgctcttgtggagaaacgtgacctcacagaaacacatgagctagagaggggagccctgcccggcccacttcccctttctccctggcagctgagagccatccatgcgtggcgtattcctctgggaagaccttgagtatgtagagtccccagaatccaacttcattcttcttgagtgccacaaggcgtctcacatggtgctttccaggatctcttctgacgtgtcccatcaggagtcctgccccgattgcggctcacagcccggggccaggtggacctggccctgtggcctcctgaaggtcttcctgccagcccccaggaatgtcacgggacaggtttcctctgctccctgctcctcaggccgtccccctgtgggtgtcttaggagacacttgtgtcccacttggtggtggtggggcctccctggcacagctgcctcatgctctctggctaaaccgtgggcccaccaggaatctccagtctggtgcctcagggtgtgccccaggctagtccgagtggagggtctctcccctgtttgggatgcctgccctgctggagtgctctgtctcggaggtggggtttgagtgcagggctcaggggtgctgagaggacagggcaggaggcctgctgcatcccgggcaggtggctccctcttgtgggcacgcagggccatgcattgctggtttagctccctctgtcctttacagccaggctctcttcatggtgcccacaagcaacatcatacaaaatgtatgataacagttatttccaaaaacgaaacttcagggcagcctttgcaatgaatgtatactagaaggacatattgttgtcacagaagcccctgtgccctgccacttgtggtggcgccactgtcttccttctgttggtgaagggcgtggcagtcgaagaggttcctgagtttgtacttgtgttgcaccgttagggctgttagcagctgatccagaagcttctggaaacaacagagagatggatatgttttctcttagctgttagaacacatcaacacgagcattggcttttagctctacttgtcagtacaagacccaaaatatttcactgtagactcaagccttcagtggggacaggaagcgtgcgtgtggggcagagggactcgtcaggcccagtgtcctggttattacattgtgtgtttctttttctccttttctttcccaaccaggttgtcctggctcgagaactggcaacctccagagaatatgcgagtgagtatgggctgcagggagctgtgcgtccgggagcagggcaagcggctccgtgcagggcggctggggtggcagggccggtgtttctgtgctgatttcagggtacaggacactgttggctttagagaccaccaggctgttgtgtacaatgtttgaaagactttaatttgtaccagttacctttgtgagtcatgtctttagtgttttttgttgtttctgatagtaactcacttctctctcacctgaagttaaaattctggagaagcgacatatcataaaagagaacaaggtcccctatgtaaccagagagcgggatgtcatgtcgcgcctggatcaccccttctttgttaagctttacttcacatttcaggacgacgagaagctgtgtatcctttgcgtggttggtgccgtctgaagccacaccagtcacccctctcacttggaatcagaccctgtgtgttcccacaagcagcccccgctccctgccgagtggggtccctcaggccgctgacattcagggaggcagccgaggcagcgccagggtgtggctgggagtctgcacaggacgttacctcccggagaagccaccgatgtggctccagcacagtcctctctgctgcggcttgcttggtcggcgtcccttgctcccctagagcgccatcttttctgttattaaaccttggctcaggaatctgggaggcaaggcccggtggaagttggggtgggccccacctctgccccatccagctgacctgtgggcctgccagtggctgggctggccacgccacaccgtcgtcacccccagcaggtgcagtctgcatctgctcttctcctcccccgccaccctccaagctggcccaagtgtcgtggcctccccatcctgcctggggaggggcctgagtcctcccacctgtcctccccgtctctccccagcacccggctcttctgtgttagagcttcgttctggcctgctcccactctcagcaccatcctgcagctccttcggctgccggcggagtgtgtgtgctctctctgtttggaggtgcttgccaagtgcaggttgatgggtgatggggatgcgctgctatgccgggtggcgtctctgcccacgagaagcttcgattttggtggaggagctggacgtgcactgacgatccgtgtcagaggcttcccggcagcaagatgcgctgccaagagtcttagggctgggtaggggctggcggcagtgtggggctctttcagctcctgggcaggagtgtgtgggggggcatgaaaggctgtggtgggctgggcccctgagccgtggcagcctggcactgactctggacttccttctctttgtggcggggaacgtggggtttgctgtggcttctcctaggccaggcgggagaacgggcaggagagcaggggcaggggccgtggtcgaggtctgatgaacagaccggtcaagagaatggagtcaggggcggctcctgggaggtggccctcaagcctagtgcacagcggtgtctgctgctgagctgggagagaccggggcgggtgctgggctggcatttcatgcatccgctggtgccaccattcaggtctgagtgggcacttaggtgctgccagcagagctccaggaggagtcagggccgtgaggactttcacagcgagctggcaggctgcccagaggttggctcctctgtgagtggagcctgggttccccccagtgcaggggtgaacacgaggaggggcccaccgaggagaggagatggtgatgggatgttgctcccgagctcgaatgatggagacccagaggccacgggatcaaacgatttctgatggagggtgctggctgcccacgcaggggttatgaagcggtcaggtgcacacagcctgacccgtggatctgccctgtgccagttgttgatggtgggtaggcagtttcttggggggactgttcaaggaagagtaagaggtgaggaaatggaaacgacgcaaggtgcttccctgggattttgcctagggaggagcggggcagtggccgagcagctgccaggcacgtggcccggagcgggctttgctgttggtttgtggaaggttgtagagaatgctggcctccaggcaggcctgctgtcctccagtgtcatccctgttcctgcctctgtctcccactctcagtggcttcttcacggtatgttctgtctctcaccttcacgttccccggggccctgcacgtctctgcccccgtatgagccacgggagtccctctgggcttcccgcagagccgtcggaacacggctgcttgttggttgtgaggctgcaacagaattgcacacgcttgacctctcccatcctctcctcccgggggctcagagtccagaggagagtgaatcttgctgactgatttccaaatgggattggccagagcggtgcaggtagtgggaactccaggtctttgtccagtggtccatgttgcccttcatcattaagtcaaattccaaagccccgggaggttgtgaaggttcactcgcccctgacgggaacgagacccagggacttctgccccaccaggcatcctcggtgtgggttgtatttagagatgggcctggacaggggccactttgggcagccttggttgcaagtcccttcgcttctgggtttctcttcgttgccctgaagcttcaggttcatccttggtgggagatgatggtgccctggcaaacagaagtgagcaggcaggccagcctggctctgagcacgagccccccttcctggcctcgagagccactgctcagggcaggcaaggatttgggtccccgtgtcctgggctgccagtaagtgtgaagtatctggaggtttccggtaatggggatggacgtttgccgcttgcaggggaatctgtatctgggatccatttattgtcggtcttaagtcctcttggaaaaggaggctacagatggagccatcgtagggcagtggtgcccagaggagggggcctcccagacacacttcatgggtgtagaagttcatgagatggcttttgtcttacaaagtgtgtcactcggccaggtgcggtggctcacgcctgtaatcccggcactttgggaggccaaggcgggcagatcacgaggataagagatggagactatcctggccaacctggggaaaccccgtctctactaaaaataccaaaactaggggggcatggtggcgcgtgcttgtagtcccagctactcgggaggctgaggcaggagaattgcttgactccgggaggcggaggttgcagcgagccgaggtagcgccactgcactccagcctggcgacagagcgagactgcatcttaaaaaaaaaaaacaaaacaaaatgtgtcactttatccacggaaggagactgcatggaaggggcagtgccacgcgtggatgcgtagcacataaagccggggtctcagggcaggggctgtcgcgctctccgaccctgctccgccggcccccggggtctttgtgcatcgaagcctgcacgtgagttatatgcgctttttggtcggggtctgtaggccctgtcaccagcggttccctttcactgaggccgtggacacggccaggggccagaggggcagtcggggctgagaggctctgttcctgtttcctcgagaccgtgtaatggcgttcttaatgagaaagccctcatcatgctggtgcctcgtcttggagctggggcctgggatgcccggcagatccagtgacatgactgtcttgggccacaggtactttcagtttgcactgaattaaaaattcttatcagacttttaaggttagttttccaaaaatgacttttacaaaataaaacacatgagccaggcgtggtagcgcgtacctacgttcccagccacttgggttggttaaggtgggaggatcgcttgagccagggaggttgaggctgcagtgagctatgattgtgcccctgcactccagtctgggcaacggagtaaacctgctccaaaacgaaacaagagatttttacacttccttaactgcacgatattcagatttcggccttagttatgccaaaaatggagaactacttaaatatattcgcaaaatcggttcattcgatgagacctgtacccgattttacacggctgagattgtgtctgctttagagtacttgcacggcaagggcatcattcacaggtaaccgcgggggtggctgggtgggtttgcaggacgtcagtttgatgatcagggccagtgaccgtttggctcacaggccacggctgatgcccagatggcccccgcccttgaggtcagccaggttggagtgctccctggatgggtgggactgagatgcctgcctgtgccacagcctgagtgccaaggcgaggccacacgtccacggagcgctgacgtggagaggctctcctgccaataccacatgcaatggttgcgtgtctttcctggcgagctaatgattcttttcaccatcttgactgatgctttttatctttttcagttgtagcttctgtgtgtacttctttctggtctcgtttttcatgactttctgataaagtcagctcagaagtgtgcatagctttcattttgtgcgttaaaaatgatagattttacttcgttaaaaaacgacttagaatgacatggagatgtgaggtggtgaatccctactgtgtccagccaacacttgttgcttgtgagctttaggcctgtagccctggttgtcagcctgtaaggatcatatacattcattcgttcattttgttttcagcaaaatttagagtacgtaataatgttgctgttttaagtatttcttctcaaatgtgaaaatctgcttttacagggaccttaaaccggaaaacattttgttaaatgaagatatgcacatccagatcacagattttggaacagcaaaagtcttatccccagagagcaaacaaggtgtgtgagttttatttctagcagagcctggctctgtgcttcagatggaaagcgacttctgaggagtgtttgcattgtgtcatcttcatcaacgactgaggtggggataccttggccgttctcaaacagatcttgaactttctctgggcaagaccctgccacgccagcaggtcttcctgggggggccccaggcagtgtgtgttggtgtagagtgggaggtcgctggttctcctcggcgcctgctctggttcatcctccctactcgtcttctggacagtgtggggggccacattcgtacccagccacccgcgtgcaggatgtggagccggtgtggtcagctcctggctcctcctgcctgtgttgcaggtagtatccgggcgcgcacatccctgtacctcggtgcgctccctccgttagctgtccgtctgtctccctgctggccacgtgcacgtttgtcatcacaaagcctccgagtcctgttcccaagggtagtttctagcctcggaccatgttgtgacaactccatcggagatgttgctgaaagtccactcgggccagagaagtggcctaggttgtcttagccggccgggggtatctcgatgcccttcaggtgcttattgggtagaaatcacaaactctggaggtgtaaagaaaggcagctgaaattctgaagagtgctcccgagtgctgggtagagagaagataaagccttgggatgaggtttggggaagctgaaggctgctgtgtgcattataagtgaccttgaaggtgaacctcgggtgattgctggagtctgtctgggtcaagaggctgggtccaagggcctccaagtggtgcatgggcctctgcctgggcttggggtgcccgtcagagaaaggcctccatagagggctctgtgggggtgagaggtgctggagcccggtttggagggacgcgagtgcaggtttgttggtggaggaaagattcagacagaagtgaccgtgttgttgtagctgctctcgtgtggaaaaggggaaccgtgagcacagagcagtggtggttctggcctcgtctccatggacggccagccggcccccagtagctggaggagagcacagctgggtggagagcaggcccttcagcaaggcaggcactctggactcagctcggcttttctgtttcttaggaattggccctgtattctgtgtgctgggaggtacccagctggtgcctgtggggcctctcttggcaccttgaggtagttgctcgtttcctccaccgggccttatctttcccttctgggcgtttccagccctgtgttttcacactcagggctctggctgagattctgtcagttggtgctttcatctctgcacagtcatggaggccctaagaccttgtcttggatctgggaacttctctcagaatcctcaaacatcaccctggctgtgcatgggagctcacacctgtaatcctagggctttgggaggctgaggcaggaggatcgtttgaggccaggaatttgagaccagccactgggcaacatggtgagactccatatctacaaaaaagccaaaaatcatcctggtgtgatggcacacacctgtagtcccagctactcgagaggctgaaatgagagatggatgatgcagtgaactaggatgatcccactgcactccagcctggggaacagagcgatcaactgttaaaaaatagtagtaataaataaaaaataaaagaagcctgtaatcccagcactttgggaggtcgaggtgggcaaatcacgaggtcaggagatcgagaccatcctggctaacatggtgaaaccccgtctctactaaaaatataaaaaattagctgggcgtggtggtgcgcgcctgtagtcttagctactcgggaggctgaggcaggagaatcgcttgaacccgggaggcagaggttgcagtgagccacgatcgtgccactgcactccagcctgggcaacagagtgagactccgtctcataaataaagaaataaaaaacatcacccttttggggctaagatcgaaactagcaatcaagccggagcctcttgttgtctaaggtggcttagtcctgctgccgtccgctgccttttgtagccccgttcccctccccgtccagtggcatgccagagtgcgcacctcccgcccaaagctgcacagagccagggcggtcttcctggcgtttcagacatgccctgaaaccttgatctgtttgactcattcctgttaaatagtaaccgtcttactgactggtaatcctgtttctgtgtacacagtgtaacctcatctccctcagtgttgtctgtgacaaagttgaaccaaacaggaacttctgtctcgtaagctttcttaggatctgtcagtgtcttgctgtccttgtgctgacttcctgcccagagatgagcccacaacattccgtggggtcaggagcgctgcgggctggctctgcccccagtcagtcccgggaaccgctctctgggctgtgcccacagccagcctcaggaaccacctccctgggctgtgctctgggcatttttcccttcgtgtggattttctttctttttttttcccctcccttattgcaaggctttatttattcataatttcaacttttattttagattcaggggatccacgtgcaggtttgtgacgtgggtagagtttctttggaatctggtatttggcacagggatagtcttgttgccctgtagccacttaaaaaaaacgggcatttaagtgcgctgatgaaatagtgaaatagcttgggcacagtggcccacctgtaatcccaacacttggggaggccgaggcaggtcgatcatttgcgcccaggagtttgagaccagcctggggaacacggcaaaaccctgtctctatataagataaaaaacaaaaattagctgggcgtgctagtgcgtgcctgtagtcccagctactcaggaggctgaggtgggaggatcacctgagcctgggagattgaggctgcagtgagccgtgatcctgccactgcgctccagcctgggcgacagagcaagagcctgcctctggaaaagaaagaagaaatcatgaaataaacctttgctttttggtagcaggaggctaaaagtctttacatcattgtaaaccagggccagttgcttgtgcgtatagatgagttggtggttcttttccccttgtttgaggaaaaggaaaaaactataatttatgtggcggattaattttagtaacttattttctgtttgaggtagttcagtatcttggaatttattcctgcgttgacttcttttgtgcagagatggcttccccaaaacaccttcaaatctagaataaaagtgttgatgggagcaaggcatagcgaggttccttacccgcgcagcagctgtgccacgccctcctcctagagggaggcaggttttcccatcgttcctgtggggtgggtagggtggcccccgtatctgcagggggaggtggtgggagatggagcagggcagtggtgtgggcttgggagattgaggaggacctcctggcagagagggacttctgcctcctctccttgtacaggagcctgtggatgtatcttggtgagggcagctgactcagagtaagcttcccacctgggctgtctctggcctgtgccctctatgcaagaaccttggggagctcggggtgtccttggaggttcagacttggagtagggtttggaaacctgtgttctgacctgtgcaggcctttctggcatgcagccaggtgtggaggcagcactcaccaaacaggaaggagaggaaggccacaggtgtgggcagggctgggtggacagggtggacgctgtgggcttcaggtgtgggcggggctggctggagagggtggatgccgtgggcttcagtcactacagtggctcctctgtcctcatctgtgcatggccatcgtccagaccctcagactagctgccgttgcgcttcccactgtgctgtggactccagacgctctcctgagggccacagctgccttgagcttgccgccattctagcttaggctggatcacccacccccggcacagagaggagctgccttcaagacggattttcctgcatgatggaaagtggagtttgcacaataaaagagagagtccccattctcccatcaccaagagcagctcttcccatcttcacgtggtttattttggtcttttccagattggcattcatttaggattggctatgatgcatggggctggggagaattactgcttattgtaaaaaattcactcggtgctagtgacctgatgcccagcatcctcagtgggttttccctgtaaaaattccagtatgtgtcgctaaaatacaaatctttttaaaagcgtaaccacaataccatactgtttgatatgtaaaaatgaacggtaattgcttaatatctcaaagtgtccagtcagagttatatttccagttgtctcatgtacatcataatgttttgttgctcacttgaacaggattcaaataagttttgcacaatttcatttttaaattttttctttttcttttgccattaaatactctcctatccaaacacatgtattttaatctgtagcttcccccatttttattttttcccttgcagtttgttgaagaaacaagtcatttgcatctgtgtggcgttgttgaacatggtcctctctcctggccactacatcacattcagagttgattctcccctccctgttcagagactggtggtgggtgttctttatccggcatctctctgtgacagcagcagcatttgtggccataattggcctaaattcatgaactcattagagagtgcagaaaggtcacagcctgatacattcatgagatgcaattcattaaagagcaacttctccccagcaacttttgggttgactcgtggtatcatctgtaaaagaaaagtaggataaatgcttctttccccttttcatgccatttttgaaaaccacacattggttctccattctcttccaatgatgattaattcattaaaaaagttattacccttcctcacaccatacacaaaagctcactccagggccaggcgcggtggctcacatctgtaatcgcagcactttgggaggctgaggcgagtggatcacctgaggtcgggagttcgagaccagcccggccaacgtgacgaaaccctgtctctactaaaaatacaaaatttatggctgggcgtggtggctcacgcctgtaatcccagcactttggaaggccgaggcaggcggatcacctgagatcaggagttcgagacccgcctgaccaacatggcgaaaccctgtctctactgaaaatacaggtgtgtttttagctaggtgtggtggtgcatgcctgtactcccagctactcaggaggcaggagaataacttgaacctgggaggcggaggttgcagtgagccgagatccacactattgcactccagcctgggcaacaagagcgaaacgccatctcaaaaaaaaaaaaaaaaaaaaaccaaaaaaaaaaacttagccaggtgactcctgtaatcccagctacttgcgaggctgaggcaggagaatcgctggaacctggtaggcggaggttgcggtgagccaagatcacgacactgtgctgcagcctgggcaacagaggaaaactccatccctgtgcctcccatctccccgcctcaccaaaaaaaa

SEQ ID NO: 13180 - DNA, 2506 bp, Homo sapiens
attagatgtgaggtctcgccatgttacccaggctggtctcccaacacctgggctcaagcagttctcctgccttggcctcccaaaatgggagattacaggcatgagccaccacgcctagcccatttcattagggaggacaaggatagtagacaggtgcacctagggtcttattactgtaaattgttccagagatttaaatttcagaagctgttgagtaactggaagtgttgacttactacaatttggggtcaccaagtgggtggcagatggattgggctgtgcaggggctgaaggactcacccgcaggcccagagtcgctggcctccctgaggctgtgctgcctccatgggactgagtgctgggacggggcgttttgggagcctggcaggaccctaccctgcacgtgggccctggccgtgcgtttcctccagatcgtggcaggcggtctcgggatgctgttaatgcagttgaatcaccacctcaaaatgctacaaaatctaccctttacaacaatagtagtacaaataaacgtttagacacttcacgctcaaagagggcttttgctcgggctttttatttcacaattgatgcttaaaagtgcttttaaaggcaatattgcaactacatttatttatttatttatttgctgcagaaatgaagttatttattaaaacacacccatggtagcaagttctgatgggtctgaagaggaggcaggagcaaggtgttgagcttctaaacatcgtcctgccagggagggaccctgacaggtgcttggctgacatgctgtggccgaggcaggaaggaagttgcagaattccacgaaggcagaagactaccagtaggcaggtcccatgtcatcacacccgtgagagtggcagtggtctggtggccacagagatgtctgacagcgtgggtctggagccggtgatcggctggctttgagaggttccttcaggaggtgcctggaccctgatggacagcccccagcctcacgctcccccttgaggtttgcagagggtgccagaagtgaccccagaaagggttctctgaggtgctgcggtccctacccagcagccaggggctctgtctggaagtggccgtgtcgtggccgtgctgaaccgctatgagtccagagcttcccgggcctcctctgctctgcggggaaggctccggggctctccccaccttctcgaatctttgctcagatatcaccttcccagcaaaggctgtctgattatttgaatttgcaccaccctcatccaaatagtcctgttctctttgcctgctttatttttctcatagtaatcatcatcatctgacacgctgtgcattttcctgctctgtgtatggaagtctgtctgtcctgctggaatgcaggcttctggagggtgtggtcttggtttcgttctctgctgtacttccagtgcccaggacggtgcccagcatggagtagctgctcagccaatgctgtggtcttgatgggactgcattcgctttacatgattgaagctgctggcgtggaagctgtgccatgtcatgtaaagcatgcagtgggaaagcagtggggtgggggcgtctttgtattacatcatctgttgttgccgtttcaaaaatccagaggcctttctacacttcagttggatgttgatttcaaaatgaccgatgtttctttctgactcatgaaggctgctgtctttggaatctgacattagagggaagcgaaactttacaatgtgtggggcagcctggtgtggtggctcaggtctgtaatccagcactttgggaggccaaggatggcggatcactcgagccctggagtttgagaccagcctgggcagcatgatgagaccccatctctacaaaaattagctggacacggtggtgcacacctgtggtcccactactcaggaggctgaggtgggaggatcacttgagcctaggaggtcgagactgcagtgagctatgatcatgccactgaactccagcctgggagacagagtgagaccccgtctcaaaacagaaaaaaagtcaccaggcatggtggcacatgcctgtaattgcatcactttgggaagctgaggcaggcagatcacttgagttcaggagttcgaaaccagccgggacaacaagcaaaaccccatctctattttttcaaaatttgtgtatataaaatttttgtatgaaagctgtgtggtacatgtttagctgttttatgtttcactttctggacatgagtgtgatcctccctgctcttgcagtgccatctaagctgtcatcagttttcctgggcgagtgatgcatctccccagctggtctgtctgagcccctggccagccaaggggctgcccttgactctcccggcacccgcccgtctctgcatagccacccccaccactttaactggatggttttgtattgaggtcaggctggacatcagctttctatgggcagggaccgtgtcctcttattggctgagtaattgggtccatagcgtaggtaagtc

SEQ ID NO: 13181 - DNA, 240 bp, Homo sapiens
tgggggctgaggcaggagactcactcgaacctgggagacggaggttgcagtgaggcgagatcgcaccactgcgctccagcctgggcggcggagtgagactccatctcaaaaaaaaagttcactccgaatgcgttagaggtctgaatgtaagggcgaagactatgacactcttagaagaaattataggattaaatgtgacaattgggttaggcagtgttttcttagatacactgccaaaaa

SEQ ID NO: 13182 - DNA, 6006 bp, Homo sapiens
agaaagaaaaacctgaaggcacaatttcttttctgttcaaaatgtgaacccaggatgtctctagatgatgatggatgataggtggggagattttttttttttttaatacagaatctcatagttttggattaattagcaccaatcagtttaaacactgactgttagaatagctgcatgggtttttttctttaaactaattaagcgttggctacttagtataagtaagtataagccgaattaaggttctgctacatctgtgtttagaatatttttttaaaactaaataagtgttggctagttttgcggtgtaagcagaattaaggttctgctacctctgtgtgtagaatattcccaatggatttttcatttttcaggtgctattttttgaccctgtatagactttaatttaaaatgaatttggtaacgtttctcctctgtctctacatatattcatgctttcacctgctcttttaacacctgcttttagtatctgaggcactttttctgaactctacttgtgcactggatccctcctcctttctctgccaggctgtgtttactttatccttacatcaccacttagtgattcctttctttgtataaacatggtaaatgtcttcattagcctaaaaggaaagaccaaataaaacctttcctaccacttggatgcatttgcatcctgacttctgaaatgcctccagcctccattttctcccttcccagttattccttagcccagccatctctgtctttagctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcgctctcttctttaccttccataatggcattaccatttaccacgccacccaagatacttactaggaacctcaaagtattgtattctttttctccatcacactcatacttaatcatcaagtccttttgagcttgtctcctcttgaatatgtcccttcttaattcctgctgccttcttagtaaaggccttcattcttttttccctagtaataatcttttccatatgttccagttaaaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgctgaataaatagtagctattattagaaaaggaagggtgaaattgacatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaaaaaagaggatacaaccaaatggaagaacattccatgctcatgggtaggaagaatcaatatcgtgaaaatggccatactgcccaaggtaatttacagattcagtgccatccccatcaagctaccaatgcctttcttcacagaattggaaaaaactactttaaagttcatatggaaccaaaaaagagcccatatcgccaagtcaatcctaagccaaaagaacaaagctggaggcatcacactacctgacttcaaactatactacaaggctacagtaaccaaaacagcatggtactggtaccaaaacagagatatagatcactggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagctgctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatgactggccatcagagaaatgcaaatcaaaaccacaatgagataccatctcacaccagttagaatggcaatcattaaaaagtcaggagacaacaggtgctggagaggatgtggagaaataggaacacttttacactgttggtgggactgtaaactagttcaaccattgtggaagtcagtgtggcgattcctcagggatgtagaactggaaataccgtttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaaacatcattctcagtaaactatcgcaagaacaagaaaccaaacaccacatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcaaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagctttggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttaaaatgccaaaatgctgtttattatacagaatattttattacatttgcaatatctttgtatatagtgatttttttcttgataataaatggaaaaattctaaaaca

SEQ ID NO: 13183 - DNA, 1650 bp, Homo sapiens
tttttaaaacaagtcaactcataccattcatctgctcaaaaccattcattggcttctcatctcactcagagcagtcaaagtccttaaaagttgcaggcctagactccctgtcctacctcaggtaccaccatatcccacctcctcatgcagctccaggcaccttggcctcagtgctcctcaaagcatcaagtatgcacttgccttggacagtctgtacttggtattccctctgccttgaatgttgttctcccagaaaaatgcatagttcactcttacatccttcaggtgtcactccactgttacctgagcaggtcgtccttgaatatatacatcagcattccctttcccccctgctttatgtatgtccatagcactcaccacgatctgactttactaagtatttattcatttactgtttgttttcccataccgaaatataaactttctaaggacagaaatttttgtgctttattgttgaatctccaatttgtagaaaaatgcctaccttatattaaacactcagtaaatgtttattgaacattaaaagtattactaatagaactttggtttttgaaagaaataataactttaattataagacgtatatgatttttgcagttttacttagtgtgacattgggtttatgagaatcgtgtacattcaagtccaggaataataatggtcatccaaattgtttgaaaggaaaataatcccagtggcaaaatgatggtagaatttgggtaatcttttttttccttttatgaaaagagattttattgaaggtaaaacattagaggttcattgagaatctctaaatccatgttttgacattgtcaagctcattgcaacttccagattgagtaacacttataacacatttccttttcaaagtgcaagatttttaaaagagacttgtcacatattcatttggctggtttcaaatggtgagctgaatgctgggtaatctctactagctccttaatcagatttaaaattctcagtgtttcctagttgtttctgcatactttatgtgagttgttatagctgtaacattacactttatttgctgtttgtgtttcgtgacttttggtaattctggcatttagaaacctttcactttgcttcaaaacgtagttatattttggagttttcatttgatatataattatttattttgcccttttatttcccaaagacattgtaagggttaattagatcattatattttattattacagattaaagttgggcagtaatcttaattatgatggaattatcattatgctaagtaattaactttacctagtttgttttacaactagaacctgccctaaatgttgaatatcttcctagcaagaaacagtctgtcattttacttacacgatgtctaaccaaaccataactttacataaactagtcgtttcggtcaaatagaaaaatgtgtgaatgccataaaaacaaaaattctcagttaaatgatactgggaaatagggaagacagcaaagtgagacttgggctcaggatggttcaggaagaaaaaaaaagaaagacccctgagtaccattaatattcctcagaaattattatttcaaaaggaaatatttctgtattataaatttttcatgagcagccattatgaaatctcacaa

SEQ ID NO: 13184 - DNA, 160 bp, Homo sapiens
acttgttgtctttcatcttttttggtaatagccattctaatagttttgaggcggtgcctcactgtggttttaaatttgcattttcctggtaagtgatggtaagcatttgcatgtcttaaacctgttggccatttgtatgtcttcttttgagaaatgtcta

SEQ ID NO: 13185 - DNA, 3406 bp, Homo sapiens
gaggtacacgtgtgctgttagagccaagagggggtcaaaataaaaagacagggcacggtggctcatacctgtgatcccagcactttaggaggctgaggtgggaggatcacttgaggccaggagttcaagaccagcctgggcaacatagatccccatctctacaaaaaaataaaataaaataaaaaaataagccacacatggtggcatgcatctatagtcctagctacttgggaggctgaggcaggaggatcccttgagccctggagttgaaggctatagtgagctatgatcacaccactgcactctagcctgagcgacagaacaagatcccatctctgaaaaaatggatgagtgaattaaatttcaaaatagagatttaatggaaaaatgagaattgttgtgtacatgatttatgaagtggcttacataatataattttggacatgaaagccctgaaaaatagcttcttattttaaggatgaacagactgggatttatttctgaaattctataattctcagtcagttgtaaggctttcattatataatagacttttttttttaaccaacggaagttggacctcttcaaaatgtgagatccaaaaaggttttggatattgtttgaataactctcttctccaaaggagactgtttttgaaaaatgattctttctgacatgttaaaattgaatatttttgacacgccaaatgcaccaaagtattatatgtcatgtttattgccgagagtagctatatagcttgtgggagacagttaacgtgaagctttcttgcatctggaagtatggggagagagaaggcttcttcacaccccctttcatgttatattctacagggaaagaatttctatcatgtagacactaggtgactcccttgtggataatttcatttaacaatgatttctgggtgttgctctatgccaggcactgttctaggagctgatgcgaaggctcagctgatgggctacagacctgaaggcctgtgctcctcagtggcactctgtaggtagatacagagccaccatctactgggtgcttctcctgagtgtgacagtgtaggctgggacacgatgctacccttcaaggagcttgaagctaaggttctgtgcacagataaaattagaataaatgcagagatgctataacaagatgtcttagaaaaaagaaaaacaaagaataaatgcagagagaaagagaaatgtataaaaggtagagagataaacataccacaagttcatagaaaagaaaggttgtgtgtttatctgtggctgggatgatcaagaaatgcttcatggataaagagcctttgagccagacattgaaagaaaggtaatgttggacttgaggtcttggagtatcctcgttgaaggaaacatgagcaaaggcataggtagggatgggaaatgccggggtgcagagtgggcaggaatcgatttgtagttgctgggcaatgatgtgtgtaaaccactaaggagaagatcaggtagcaaaggtccttggaggccagaacccagagggccttgaatggcatgtgactaaatgatttaaacttaagttactggggagcaatggaagaatttgagtggctagagtccccatcctgaagaggccttgcggggatcagcatgtgggtgcctctggactgtgaaatagccagagctgggaagccttttagagctgctgttgtggtccaggagggaggtggggagggcctgggtgaggggaaggccactagatggagaaattgaatttatgagatgggatttaggaactgcctagataataggggttggccgatgggaagcaaaaatgcccccagagctttgaacccaggtgccattcattatttctatgccatctgccaggcattgcatagctattatctcatttaatctcctcctaatcttgtgggttggtattttcatccttatatcagagacgagaaaactaagggtcagagaaaattagcaattggtctaaaattgtacagttgtaacaggatctagaacagggacttcagtacaggcctccctgacccccaagcctgtgttctttctactgtactaggcttggaagacagcgtacgtgagagcaaagacaagctctgtccactctgtgcatattcagtgtaggtgctggtgagattcccgccttcaggtgtccagcaagtggttggagacatggagccgaatctcaaggacattgggaggattgaaggtcaaggcttaagaaccatctgcatcctcatttatttattcagcagctatttgttgtgtcttcgtggaccagcttggcagcatgaatgctgtgaccaacaagagaggtgtgtccttcacggagctgccaggctgggagggagccctgatggcgtggcttgagtgtaaggcaggaggtgtgcagattggctgtgggaacttactggcctaaccttgtcaggtcagggaagctctctagaggcagttgtggttctcaacatgagactcaaatgatgaggacccagataaaaagtgggaaaacagcataccccaggccgtggaagtagcgcgtactcaggcagagcaagataagaacacagtgtctttaaaccaaaaaccacgtgtggctggaatggagggaagagcaaggagataagacaggtgagcaggaaccagaacaagaaatgccctggaagctgtgagacgcttggaattcacctgtgaagaaaagagtagcctcatctgaattccttgcctcgattatggtctccaatagaagattaaatggctgtggagtctagaggttttttccttcggtgtgggcatcaccccttctgaaaggatggtgtaatggctaattgtatgtatcagcttggcgaggccacagtacccagatacttggtcaagcaccagtctagatgtcgctgtgcaggtatttttttagatgaggtttaacatttatatcagtagaaggagtgaagcagattatcctttgtaatgtatgtaggcctcatatatcatcagttgaaggccttaagagaaaaagattgaagtccctaaagaagaaggaactctgtctccagtctcccttcagactcaagactgcaacatcggcctggcacggtggctcacgcctgtaatcccagcactttgggaggctgagatgggtggatcgcttgagatcaggagttcaagaccagcctggccaacatggcaaaaacctgtctctatttaaaaacacaaaaattagttgggcatggtggcaggcgcctgtagtcccagctacttgggaggctgcggcatgagaatcacttgaacccaggaggcagaggttgcagtgagctgagatcatgtaactgcactctagcctgggcgacagagtgagactctgtctcaaaaaaaaaaaaaaaaagact

SEQ ID NO: 13186 - DNA, 3406 bp, Homo sapiens
gaggtacacgtgtgctgttagagccaagagggggtcaaaataaaaagacagggcacggtggctcatacctgtgatcccagcactttaggaggctgaggtgggaggatcacttgaggccaggagttcaagaccagcctgggcaacatagatccccatctctacaaaaaaataaaataaaataaaaaaataagccacacatggtggcatgcatctatagtcctagctacttgggaggctgaggcaggaggatcccttgagccctggagttgaaggctatagtgagctatgatcacaccactgcactctagcctgagcgacagaacaagatcccatctctgaaaaaatggatgagtgaattaaatttcaaaatagagatttaatggaaaaatgagaattgttgtgtacatgatttatgaagtggcttacataatataattttggacatgaaagccctgaaaaatagcttcttattttaaggatgaacagactgggatttatttctgaaattctataattctcagtcagttgtaaggctttcattatataatagacttttttttttaaccaacggaagttggacctcttcaaaatgtgagatccaaaaaggttttggatattgtttgaataactctcttctccaaaggagactgtttttgaaaaatgattctttctgacatgttaaaattgaatatttttgacacgccaaatgcaccaaagtattatatgtcatgtttattgccgagagtagctatatagcttgtgggagacagttaacgtgaagctttcttgcatctggaagtatggggagagagaaggcttcttcacaccccctttcatgttatattctacagggaaagaatttctatcatgtagacactaggtgactcccttgtggataatttcatttaacaatgatttctgggtgttgctctatgccaggcactgttctaggagctgatgcgaaggctcagctgatgggctacagacctgaaggcctgtgctcctcagtggcactctgtaggtagatacagagccaccatctactgggtgcttctcctgagtgtgacagtgtaggctgggacacgatgctacccttcaaggagcttgaagctaaggttctgtgcacagataaaattagaataaatgcagagatgctataacaagatgtcttagaaaaaagaaaaacaaagaataaatgcagagagaaagagaaatgtataaaaggtagagagataaacataccacaagttcatagaaaagaaaggttgtgtgtttatctgtggctgggatgatcaagaaatgcttcatggataaagagcctttgagccagacattgaaagaaaggtaatgttggacttgaggtcttggagtatcctcgttgaaggaaacatgagcaaaggcataggtagggatgggaaatgccggggtgcagagtgggcaggaatcgatttgtagttgctgggcaatgatgtgtgtaaaccactaaggagaagatcaggtagcaaaggtccttggaggccagaacccagagggccttgaatggcacgtgactaaatgatttaaacttaagttactggggagcaatggaagaatttgagtggctagagtccccatcctgaagaggccttgcggggatcagcatgtgggtgcctctggactgtgaaatagccagagctgggaagccttttagagctgctgttgtggtccaggagggaggtggggagggcctgggtgaggggaaggccactagatggagaaattgaatttatgagatgggatttaggaactgcctagataataggggttggccgatgggaagcaaaaatgcccccagagctttgaacccaggtgccattcattatttctatgccatctgccaggcattgcatagctattatctcatttaatctcctcctaatcttgtgggttggtattttcatccttatatcagagacgagaaaactaagggtcagagaaaattagcaattggtctaaaattgtacagttgtaacaggatctagaacagggacttcagtacaggcctccctgacccccaagcctgtgttctttctactgtactaggcttggaagacagcgtacgtgagagcaaagacaagctctgtccactctgtgcatattcagtgtaggtgctggtgagattcccgccttcaggtgtccagcaagtggttggagacatggagccgaatctcaaggacattgggaggattgaaggtcaaggcttaagaaccatctgcatcctcatttatttattcagcagctatttgttgtgtcttcgtggaccagcttggcagcatgaatgctgtgaccaacaagagaggtgtgtccttcacggagctgccaggctgggagggagccctgatggcgtggcttgagtgtaaggcaggaggtgtgcagattggctgtgggaacttactggcctaaccttgtcaggtcagggaagctctctagaggcagttgtggttctcaacatgagactcaaatgatgaggacccagttaaaaagtgggaaaacagcataccccaggccgtggaagtagcgcgtactcaggcagagcaagataagaacacagtgtctttaaaccaaaaaccacgtgtggctggaatggagggaagagcaaggagataagacaggtgagcaggaaccagaacaagaaatgccctggaagctgtgagacgcttggaattcacctgtgaagaaaagagtagcctcatctgaattccttgcctcgattatggtctccaatagaagattaaatggctgtggagtctagaggttttttccttcagtgtgggcatcaccccttctgaaaggatggtgtaatggctaattgtatgtatcagcttggcgaggccacagtacccagatacttggtcaagcaccagtctagatgtcgctgtgcaggtatttttttagatgaggtttaacatttatatcagtagaaggagtgaagcagattatcctttgtaatgtatgtaggcctcatatatcatcagttgaaggccttaagagaaaaagattgaagtccctaaagaagaaggaactctgtctccagactcccttcagactcaagactgcaacatcggcctggcacggtggctcacgcctgtaatcccagcactttgggaggctgagatgggtggatcgcttgagatcaggagttcaagaccagcctggccaacatggcaaaaacctgtctctatttaaaaacacaaaaattagttgggcatggtggcaggcgcctgtagtcccagctacttgggaggctgcggcatgagaatcacttgaacccaggaggcagaggttgcagtgagctgagatcatgtaactgcactctagcctgggcgacagagtgagactctgtctcaaaaaaaaaaaaaaaaagact

SEQ ID NO: 13187 - DNA, 360 bp, Homo sapiens
caacttgcaacgagctttcttggaaacatagacgtgtttatgttgttgagtcttgagatgaacatgtgtgggcttctgacgacactgatgcccagtttgtatgattggatgatacctgaaaagtgggtcacttcctagtcagtgaagggtacacagggctgaataggcagggctttttggctttttccatgcttttgtttttgtttttggtgtgtgtgtgtactaattttagatactcagctaggtacttgactggctatcctttttagcatgtgatttaatttggttttacccatcagtatttatttcaaggggactaaataaacacattaaatgaagcacttaagaactttctatctt

SEQ ID NO: 13188 - DNA, 360 bp, Homo sapiens
caacttgcaacgagctttcttggaaacatagacgtgtttatgttgttgagtcttgagatgaacatgtgtgggcttctgacgacactgatgcccagtttgtatgattggatgatacctgaaaagtgggtcacttcctagtcagtgaagggtacacagggctgaataggcagggctttttggctttttccgtgcttttgtttttgtttttggtgtgtgtgtgtactaattttagatactcagctaggtacttgactggctatcctttttagcatgtgatttaatttggttttacccatcagtatttatttcaaggggactaaataaacacattaaatgaagcacttaagaactttctatctt

SEQ ID NO: 13189 - DNA, 4758 bp, Homo sapiens
ggagaaactcctcctcataccttctgcaaagttgacaaaaacttaaattgtggaatggtaagaataaagttttcatcttcaaagtttcatatgaaaccaaaaagggatacgttttggattcctgtttactgttgggtatatactcacattttatattttcatgatgcttgtttttatttttcctaatttttatgatttgtaataatttttaaagtcctatcccatgatttataataatttcatctttaagtcagggatatttttgagggagtaaatcctaatattgtctgtgttacattaacaaaggttttattcacttttggatttcagtggtgtcttcagggacaactgtggggttagagtgggtagaagctctccttacattcatttattcattcattcattcatttgtttgctttttttatttttttgagacagggtcttgctttgtcgcccaggctggagtacagtggtgcaatcacagctcactgcagccttgaccccccaccaggctcaagtgatcttcccaccttagcctcccgagtagctgggactacaggatagtagagacagggtttcatcatgttggccaggctggtcttgaactcttgaccttaagtgatccacctcccttggcctcccaaagtgttggaattacaggcgtgagccaccatgcccggcctgtttttgtttttgagacagggtctccttaagttgcccaggatgctcctgaactctagggctcaagagaaaatattgcagttttgcatacttatttttttttttcagacggagtctcgctctgtcgcccaggctggagtgcagtggcgtgatcttggctcactgcaacctccacctcccaggttcaagcgattctcctgtctcagcctcccaggtagctggggctacgggcgtgcgccactacgcccacctaattttgtatgtttagtagagatgaggtttcaccatgttggttggccaggatggtcttgatctcttgaccttgtgatccacctgcctcagcttcccaaagtgctgggattacaggcgcaagccaccacacccaatccatgcatacttactctttaaaaggactgtagtgaagaagaaaatgaacataaatgtttgattcatagtttttaaagactacagcttacttttggttcagatttactttgaaaaatatcttcaggtcaaactaatattagcttaatgttgtataggcggagatgacaaatgcacccagaacaattagtgaagacagggttgcctctggaggtgatgacctcatagtcctccagtgacccaagtcttccccaatttgggctccagtgcacactccgttttgtgctgtgtcttacaagaaggggcaatctctgagtgattgtgaaattctaaatcttttgaaatggccttcatatcagtttgatttttgtagcattgttttcttactctcttattttagtgttctgaacttcatgctttgctgtattttatactgcatagttcattatataaacgttttaaatagactcttctgagtaaataaatgaatctttagttggtatccaacaaaatcaatttcttttcactcttttgtcttttttataaacctaattcatgttttacagtggggttccagcgtgtttctgtgttataagaagtctgtacctgcttcaaatgcaatagcatataaggctggtaagtgagttaaaaaaaattgtctcaattgctatagttattggtgcatattaacatttggctaaaagagataaagtatgctcccttacatagtttgtagaattgatctattcataaaattatctataattttagcatataaagatatgtgttttcttaaatacatatacaagatatattaatacccccaccaaacatgctgttaatttaatttaaacatttatctaaagcaaacatatgtggaataaacattcaagcttttggtctacgttaatagacttaacagtataatggaaagttgctgactctctgaccttttatattttggcaatcagaaaggtgtcaaactgcgtctttacttcttatatttccttctcttatctctttgtgtctgatttgaaaccacatgttacttgccatgaaaggtggacttgcttcctttctcctttgttgcaaagaatcagctatatggaggagaggagggcctgagaaacttttctgccatgaagtgtttgagaaatctatcgccacattcttactgcacattaaagtgtcaagggctgtaaagatttaagtgtcacgtcttcattccactggtatggtgggataaaaactgaaaatacaggtatgctccagttgtaaatagaaaagatactggaatacttctttgtgaaaagaagcagtgctaattactatttgattatgcacagttcttgaaataaagttttacttcagggaagtcaggcaaattcatatccaaaaaatcgtgattttcataaaaacattcatactaatgaaccaaaccatttaatttataatataaaaataatggcaacgactaacgtataaaattcagtatcattttaaaatctgatactgtaggctgggcatggtggctcacgcctgtaattccagcactttgggagagtgaggcgggcagatcgcttgaggccaggagtttgagaccagcctggccaacatggtgaaaccccgtctctactaaaaatacaaaaattagccaggcgtggtggcacgcatctgtagtcccagctacttgggaggctgaggcacgagaatcgcttgaacccaggaggcggaggttgcagtgagccgagatcacaccactgcactccagcctgggtgacaaagcaagatcctgtctcaaaaaaaaaaaaaaaaagtgatactgttaatactgctgtaatatgttgattatgtgtgatgtcctttttttgttgttgttgttgtttttggtggagaaaagatatcacttaaaaaacttatagaaagaaactgtaccaaagtattcagttatttgatatgagacacttattttagaatagagagttttagatactgaatttgggctcaaaattctactactgattttgaagtttttcacttagagatggtctatatattgatgaccttagaggctaatgaacagatgccatgtagctaatttattctgtgggtcttcattgtggttctcaaagtgtcacttgctcctactttctgggtctcacatactctgtacttagtcacagtgtttctgtctcatttacttttcatgttgcatgccttttacactgcttccctcttaagatgagtttaggggctgtgataatttctgttgcctcagcattatttcataacacttgtctcttccctgaatttttcacagaagactaactgaaatagttggtaaatttttctgtatgtttcttaccattttccacaaggtgttggcatgtgtagaagaaaatacattaagattggtgatcaagattggttgaatggaatctcaactagtatattaatacattttaaatgttacaatgaactgtaaattcatgggtaaaatatcaggggtaaacttattttagtttctgttatagcaagggggaaatcaattttaaaataccacacaagtattgccatgaaattcggcattaaaatattccattaatacctatcatatgcaatttatggaaaagtaactatttaaaaaatttattgttgtctcattcttcaaaaggtttaatttttagatatccagaagaggactatgagtcatttccactctcagaatcagatgtacctcttttctgccttcctatgggagctactattgagtgctgggatcctgaaaccaaatatccacttccagttttttcaacttttgtcttgacaggttcttcagccaaaaaggtatgtttttgtctcattgattaaacacattttgtccatgtttttatttcataaaaaggttaatacaagttttatttgaatgttaggattatttggacatgatacattttggtttaaatttacactgtcatccccaaggtgagaaatcaacatgaaaattgctatcaggatattgatacctctggaacttctacagaagcaaagataaagtctctctggatagacaccttcaaaacccaggtgtcaagatgagatgattatgacagatcaaggacataggtaccatagaaagaatcgacagacacaattaaaaagcagggttagaccctcaagacattgaaatgacagaatgacaatataaaggatgttataaattaaaatatcattgagatgacctaagaactaatggaggggctcaaaatatcaaggaaggaacaggatattttgaaaaatgaatagattgggaaaagaatcaagtgtttagaaatgaaaaatatggtccttaaaattaaaaattcagtgaatgggttaaacagcagagataaggccaggtgcggtggctcacgcctgcaattccagcactttgggaggctgagacaggtggatcacttcaggccaggagttcaaggccagcctgggcaacatagcacaactccgtctctactgaaaatacaaaaaattagccaggcttggtggtacacgcctgtaatcctggctactcgggagggtgaggcatgagaattgcttgaacccgggagacagaggttgcaatgagctgagactgcaccattgcactccagcctaggctacagagcgatactctttctaaaaaaaaaaaaaaaaaaa

SEQ ID NO: 13190 - DNA, 439 bp, Homo sapiens
ttctcctgctgaaagtagtaaatataactgaaaattttaagatcttcaaacattagttacctaatatgctttggcagtagagaacaataaagtctcatttgagatgtgggtactaggtgatctgcttggctttttcattgtttaggggatatcaacatgtaagcattgaggtgtgtaaaatttaggtatttgtcattgcttgttaaaaactttgagatcactttgaaataattatatctgggaatattgtgtgtataaaggcaagggttataatgaaaaaacagttggcaagatttataaaatacagaagtaaggattgattgttgggagaaggggatgggttaaaaactttgagatcactttgaaataattgtatctgggaatgtgtgtgtaaaggcaagggttcctgtgatatatataatgactaaacagttggcaa

SEQ ID NO: 13191 - DNA, 10885 bp, Homo sapiens
agcaaagaagattttctgaatatctgcattgaacctgacaccatcagcaaaggagactttataactatagggtaagtggactggggttcacaggaaatgaggcttgtgattttctcagattttactattcagagtgccccatgaagtctaagacagaaatccagccaaagccttgtcttgtttgggaatttcgatgttatttctttcctatgggctgacatgtagagtgcccctctcctatgctggccatcactgttcattttgtggggatcagaatgtaagagcagtctttgtttttcaattgaaaccaaagaattcaatggagcatgacacagcgtcaagaactttggtttcagggtcaaagagctgaatgcaaattttgattctgccacttacccgacgtcatgactcggatcatttagcatctctgaattctttccgtctacagaatgaaataatcatctctgccgatctcaggactggctttcagccttgagtaagagaatgtgtgtcaagcctttttatattttgaagcacttcacagtatccattactatttatgtcagttcaccatgtcctcctattcccagggccttcatgaaaaactggaaaaggtattgagtaccttggacatttcccaggcctttttcccttttccaatacagaatacccttccaagttctgtgatttgttaagtcctacctctgccagaattttattggtaaagaacactataaatcctccttcagggcatctgaggagctggtgtgttcccatgccaactggtaatctgctcagctccgcttttctgtgctttgtctcagagctccctctcgtgcccatttagggatcacacatttctgctgcagcggcctggtctccatggctacttcattatctacacaggcacataagtttgttgttcttgcctttggcataaattcttcagagactgaatagctgattctgcagcctttgattttcttgctgtatctataagaagggaaaatcctgttccttctacagaatgtccagaaatcacacaatcttcattgacagtctggccagtgagaccagcaatattcaaatctcctttatgatactggtatccagaaatagagaccccaattctattgctaaggttaggcgaagccactatgttctgcattgttagcaccagtggcagccagtgtccttctgttctctacaggaagtgaaatcaagtaatgtctgtttcctctggatatctgaagagaacatagtgaagctgcgttagaaaactctgataccgttttgtagagttactgttgttaataaatgataaatggactgatttacttagattagcttttactgtatttccactgcctaaaagatacatctgcatgaggtggagtgtgtgtctgtatatgcgctggaaattttactccatagtcactcagtcaaggtagatattgtatgccaagtagaccgcgttataaatacagtcatcccacggtatccttggggtattggttccaggacctccctcagataccaaaatccacaggttgtcaagccccttctatatagtggcacggtatttgcatagacttaggcacgtcctccctatgcacactaaatcatctctagattacttataatactcaatataatgtaaatgctatgtggatggttgctgtcctgtattctctaggggataagatagtctgtacggattcagtacaggtgcaaaaatatgtattctctatcctcagttggttgaatccacgggagtgggacccacagataggaagggttatcagagaacttctaagactagttgttcatatacataaaagaaatatctacattaaagtaaaaatattttatccttcaagtaatcacaagaagtaccaaataccagacgtttagtacttttcctaaagaatttcattctaatttttaaatttgagactaacaatctaagaattaggtacatgtggaatgattatttttaaatcaatcaatttttaaatcaaattaagagcatttcagagaaagtcataacttcatgcccagttctctactttcagtctagaatgtatcacaaggctaagcaagaatcactgttggaaaaattatttacagaattctatggcttaatagaccatctgtccacttatgtaagctcataaaaagggggaaagaagttgctacattgttgcaacctagtgcagttgccatcactggtcttaagcttgctttttcctgtgctcacagaagtcgaaaggtgagaaaccccaagctgcacgtggagggcacggagtgtctccaagccagccagtgcactttgcttatcccggaggtgagtggggaaggggtcggtagtcacagcatttgattcgttcgtcatcggcctgcccctctgtggtgtcccatccttcctctctgttagctgacctagacttaggcacatattgtgtgccaagcattttgccaggctctgggtcatattagcggggagctgaaaaggatggcagaatctccttgggagtcatggatttagagttggacttctgaagactcccatcgttttcgaaccaaggttcttccctaaagtgagttttaggtctccttttatttttccatatgtaaataatgcagaaggttactacattaagacacatagagaattgtctagctggcaaatgttaatagtggcttttactttaacattttttataaaggatctggaagcagttttcagttcaacactgaatttttctgtattatgaaatgccatgcttagaataacctatgtaagtgaaaaaaattggaaatagaatctggaattgggaggttattcaattgtcaatacggaaaaaaaggaggctcttcatatagcctttgaagacatgtggccatatattactgtattcagacaagactataggtaaacagaaggtatccccatagtgactggcgtcacagtttcgatataaatattgaattaaatgcatgagttatggaagggtttcatagactgtaatgatattaatgttgatacaccttgggtatatcaagctaaacaagtcttagagaataatgaaaatgatccagcagatacaatagcatgtcataagagaattagctgtctttatttttatttgagaaggattagcataatatagaaagactatgtatatgagttccttaagacatggcaggacccttgccttttaatacatatttgaaaattataaccatgttgttcaaatcccaaaatactctgggaggagataggggccaaaaaaagaaaataaatcctttttcatggatggtagaattaggatgtttccagaaccagcactgtgcccatcgtagtaggcactgaatttttttttgtaaaagaacattaggatagctcctcaagagaggatgttgttttccataatgaacttcttctggtgctgctgtgagacctccaactccagtaggccactgatgtgtttgagctgttctgaatattctcttctccccagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccagtggaacattttggattttggatttataatgcaaagattctaaaatcctaaaacatctgaaatctgaaaatacttctaagtcccaagcatttcgaataagggatactcagcctgtaataatatatggttacatagcacagaaaataggaacctgactttgaatccaggccatttgatttacagagccaccgatagcaatgtactctataccggttctaaatacatactgtaactccccaagaggttaaaaatgaaataaaagtttagaatatacacatataccaaatatatatcaagtacataaagttttaaactgaactttgataagagagtttgtaaagtaaaagggtggtggtctctgtgggattctagaagtttcctgatgtaattaagggtacacagccctggctcttctgggtggcgcagttattcccaactttgtttcccattacctggagaaagtttgtccagaccgtggcttctagaaggacaggtagcagctccccaatctcctccatcatcactgtaagtgaagtcaggttcagcccccacaggctctgctcatggagtaggccaccattccttcctaccacaaaccacatttctcggactggagaagggattgcagcacgcacgttcatgttaaaatgtgaactttaattgtaaaaatcattttctgtaaatatagttatatcaacctctctgcacacaacttggttcagatatatacagatatgatattcatagatgttatttgtaccacagaacaaaatcaattcaagaaacatttacttttagcttcaggattaaccccagctttctttaggccttaaaattaccaccactggaaacagagagagagcacggcatacctgggcacaccagtattcagggcaaaatctatgcagtgtcttactaatttcatactatgaggtaaagacccgaaacaaaaatagattcagtctctcgtattgctataactcttaggctggggtattaatcaaaataggatttttacatttaaggcgacagggaggctatgctgattctaactcagaaagaaatgggaaaacagtttttctaaggctacaactatttgtttaggcttattttcccggacctatacaaaaattcagtcaacaagttttgggtaaataaaggaaattcattttgctttcctctgctctgtccctgaagtcactcatccaggttggctgctcaaacaccaagaatctccaccattcttcacttgacagtctttgtggacacgttagacccaaacttttttttgtataacaccatcttaaaattttttagtatactttatctttctttagtttacccaaaggaaggagttttcactctaatgtcaatatatttgcaaccatccaactcaaagacctctgtgtcgactgttcactttgtggatcatctctggctcatttaaaacatcctgcctcatccccacattcgctgactggccttagaaagcaaagtaaatttattgttagtctaaataagcattctatagcaaacataagtaattcacacctggcctactatgaaaattaaattttctgaatttagatcatattagctctaaaagccccacagtatgctaaaaatcgaaaataaattctaaaaagaggaaagcaaggcttttgtctccatcatcatttctttatatagcactagaaaattcttattccccttctaaatttgcaatttcatccaactgcccctaaattctagttccaaaaacaaattaaagtgccagttataacactacctcccactcccacctctctcaagaaagaggcctaaaaataagaatgatgacatttacccttttttgtactagagctttactgaaggttggtatttttatgtcaaccttcctaggactgtcaagtctgcctcctaaagagcgctgtcaggatttcatagcacaatctccttattcactctccaaattatttacatagtaaaacttctatggggtctcagccaccaccaaattacaaaactgcccatttcttctagaataatagttttaaaatttccttccatttcagtatatgcatactcagttcatcacatagtaatatcaataaaaaaataaacttccatttcttataagaaaaacattaacttaattcacagttagccttttcccacaacactcaatactccagtagcttctaggaagagaggtatattagtgataaaaatggaatattaaaaatccatgacttgggagtaaacggagcccttaactcctcctctccccctacctgaatcacaaaagggttttcctgaaatgagaggggatgggactggggtcagcaggattctcacctcggtctaactacaaggtacggggagaagacaggagggctggccatttggcagaatccaagcctactagcttgggatctactagggagataaaagcccatgcctggcatattggtccccattctaattgtcttgcccatgttagacctgtcatcacactaaggcaagtccactgccaagctgagcattatcctattttattcatccacctgcccctcctcctttacctctgcaaggttgacctatacagggtctggagaaagcatctcaatccattccctgggctatacagtttcgaagggaaataaatggtccctcgggtttctgccttttctcggagggttgatgtcctaaaactgaaagcctaattcattactgtcctttacaaaagcttccctgaaggcctcagtttaaagatgagtgatttcatcttttactgtgtttgaagggctttcagtgcatcaagactgagagcaaattcatcctcatagccaccagaaggaaaaacaatgatttagctaagatttaatttatcttctagctaaagtgtcatcggtagtcacatgatcaacaaatgttcacatgtggcatctggaagcatgtgcacctgtgtgctatcttaactttcttgtcttgactttaaagtggaacaaaacaaggtaagttatagatgcaagttcctaagctaaattacttctattgatacatcaatgatttcagcttccctccccctaaccaggtggaagcacagatgctataatggatgatggatatggaaggcaaaagccttctaattcattgcaatcataatttactgaggactgtacaggtcccaggtgggacactgacactggaatggtctctaccaggcatagggaatggttcgtgtttaaaggccaagcaaattctaaacacataatttgggccatacttttagtctggtaggggataagccctaccatttcaaactccttgtggagagtcctaagccaggggccaactggacattttcccaaaggctgggcagtatcatctgctgagcctacagaattgaaaatgccctcttgaacaggcctttgtcatattttgcatggataccaacgagccccaaacctgaattccactcccacctggaacttcttctgacttattcaggaacaacagggcagcccagccagcatctcaggtcagcaatcatttccaaactggcacatagttcatttcacagtgtggcatgagatcaggctgacagcttcacaggagaactaggcctgctcaggcaggcgagggctgaggcccggcaggagatggtggcagaaggtgtcacaccacaggtatccaaccctcctccaggaggccggtggtcatcataatgcccgcccctaaagagcttacagacctagaagtctgtgaacgatgttcagcactttcttctgaacaaaagcagatggtttctcagaaaatatttcaagactggcagaaaagcaggtccacatggctcctagcttctgctgccactgtggaattccctagtagagaactggtagcaaaggatcctaggttgtgcctgttaatctgtcatgttggggagcagaatctggcatagagcaaggcttcgaaaggtgatttccgaagccacaggctccacttcatagcccaggcaagacatactctgaggatgctcaacagtggcaaagg

SEQ ID NO: 13192 - DNA, 269 bp, Homo sapiens
aggcgcccgccaccacacccggctagtatttgtacttttagtagagacggggtttcaccacgttggccgggctggtctcgaactcctgacctcggctgatccgcccgcctcggcctcccaaagtgctgagatcacaggcgtgagccaccgcgcctggccaaaaattatttattttttagttgacaaacaaaaaccagagtctgaatgttacctgctctacagtggcacctgctaaagtttgagaaccactgccctgggtggccacatcg

SEQ ID NO: 13193 - DNA, 2013 bp, Homo sapiens
tgcctctaaccacctacccccagcttaaaacaccctgaacctcaggataccacgaaaaataaccattacttgacagaaaggacccctcaacccttgagaggcaagaagagagggttgcatgtaaaggagaataaaaggtgaggcttcaacctcgaaacacagatttttttttcttttgtaaacatacacattactgaaatgacagcaacccacattgcagaggagaaaagtctattagctgtacagtttacatttcaatgcccaaacttatttatatatttacataaagatgctaccttgattaatcaatgtctatttgcatttccacatgtgaatttcttcagttttgatattccatatgaaggagctacagtgaaaacacttttgaataaagcagtgaaccctaagaatcttatcttgagatgagatgtgtgaaccaccatttgaatgttatttctccctgctgtgtacattagtctggctgggtgttggtcacagacatggatgcactgacggctattcccataaccgagccaggcgggaagggggaaaaggaagacattatttgtcaccaacaacccagtatcccaagtcaaaattctcaactatggccaaaaaggcctaaactcgacccacaggaactggctttctaactggttgacaaacacgtaagctgccctcctgcaaaagccaaccagagaacaggcaggtggcaacaggacccagcctagagcagagcacttcagaagaggatggataaatccatcagggatgctcagggcttcctgaccactgtcccgggtgaaggcactgccacattttctctcaacaaatctgttatgtccctggatccaattatttagcctaaggaatgtcacctctgctaaagagaagtgtgtttgtgaggggtccaaaatgataaaccgtcttgttagcatcatgctccaccctctgagttaaccagctcagatccttgctagattttggaatccagtaaatctgtgttgacccagaggtgctgctgctaatgcctccagagaattcgtgtccagatgaagagacttagagtggcttctccatcctgctcgaacttcaattgctctatcctccggtagtccaaacttcagcctttaaaaatacccaacttactccaagagcattattgaacccttaagagactaaactggaaaattaatttgcttgcaagctccaaggccagcattggcccttagcaattcaccaattcatcccaagaagaggaaggttcagacaaagaggaacattacattgcatggccaccatcaagttactttgaggaaggtttccaggcttcattctataattttagttttcagctcactgataagcaacctctttcattctgaccataagataagctcatatttggtgtcagaaacatccttttttccctctttgtggtccctactcaagtaaacagagaagacataaagttgccctaatgaacaagaaaagggatttgatcccaagactatagactcctagaactactaaaaaccttaaaagatcatctggtctagtttctgcctttaggcagatgaacatctaaggccacaggggacaggtggttgtcttattctcaaatacatcaagggacaaagaccacacagactttctgaacagtccatcccaatgtttccagagctcagcctactcctagtgatacaactcccatgaccaagcccagaggaccagcagctctgggagaaagtggcagattccaatatcctaacatggcaggacacaaaaccaaggtgatctcaccttatctctagggaaaagggcagaaaggaaattgcaaaaattatgtttgttggaaagtataaacaatattcctttgtgtcaacttaataaaaaatgaggccctctggggccctggggtgaactccgggctgctgacatcccacgtgaagtggctcccagtcctgttggctcctcctacgggcaacaggggttgtcgataaccagcatgac

SEQ ID NO: 13194 - DNA, 1624 bp, Homo sapiens
tcagagtgtgtgagctccctagtaggtgcagtagtaatagtaggcaccctttgctgttattgttatgaaaactgtcagctccaggatggtgctggaggtgacgatgatgttgatgacagggttgttaggaatggagttagtggcaagtggagctacagatgggcccacgggtatgagagctactaacaggaactttgactcaatttggcaaaatcgtatttcaaatctaaattctctttccaccagctccttttgctataagggaaagccaagtggaaacgtagaggcatgtgcacccagatctcctgaaaagggcaataggagagggtagcagggaggagacaatcctctactgagctgaactggaaacgcctgattgtcatttcttccctgctttgccactgacgcccgcagcagctgatcaggaaagtatcagatgccttcactagctgtcactaacacctgcctcctgaatcctgatggggaaaatggtgtcatcgggccctccacataaaatatttagtggcacttgcttccaaagaggcaagcgtggcctctccttggcatcaggaacgctccgagttcatgtgctgggagacctcttgttcaggcagaatcctggagcagcatacttggtttgagacttggagtaggagagagggaaactggtagaacagagactaggcaagttttggctcttgagaatgcatgtgacaagtgacttcatgcactaaacagagagggatgtgacagaaagaagaaagcatcattattaagagaaaactcctgaggttgacactagcagaaaattggggataggaggaagtcacactgggtatgcaaagtcaaatgcatgtttgtttaccagtgtctaccaaactgaggatgggaaattcattctaagacagatgatgggatggatggaggtgaggagctggaaataatgacaaataaattgctaataacaaaggctaatgtatcttaaacacttaagatggccatgaactgttctaagtgcttttatatgtattaactgatttcattgtaataatcctatgacgtagctactagtactaaacctattttatatagatagttagataacatcatagaatggctaagtaccttgaccaagtgtacacagctataggctccatttgcgtccaggcacctaagttcagagctcatgcatttaattgttatatcgcactgcctctcaccagaggcacaaaggtgggctccatcctcccttactcagaatgtggataggagtcctgatctttgcccactgggctctgcttggaacagccacttagtcacatcaatttggcatagaaagatgaaggctctcaacgtgcccttgaagtcagctgtcttcatgaaggccacactcccaaggtggggtgcaaacctcccctcactgcaggagactgtgcctcctcttgactccagtgtccaatgacagctgctcccccccgggcagtccctgagtcctgtgagatgaattcacttggctggttatcaggagtggcctgtcccaaagcaaatgctgcatgagggtgagaggaaaacagcccagctggagtggtctgtttagaactactggcctttaaaaaaaaaaaaa

SEQ ID NO: 13195 - DNA, 2317 bp, Homo sapiens
tgaggacccacccaatggaaggattcttctcagccttgaacctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtc

SEQ ID NO: 13196 - DNA, 440 bp, Homo sapiens
catttcactgaagacgagaagaaaaattatttcaattgtagcagcttgaaggcctgaaggtggatgttaggaagaacagggagcatggctggacactggggagcattagtgagattattaggtttggttgaattggaactagatatcagtgacttagaccagagggaagctgatttctctattggttaaagtcccagctggtagtaaggttctattctacaggccaagagggctgcaggttcttagtttttcactgtgccattcatggggtattcctcgcatccccacagcccaggggtcccctaccagccaatggaaagccagaaaagggaagggatgaacagtctcctcttaaagacatgactgagaagttgcttacattctattggccagaaataaatccatggtcacatgacaggctgggaaatacagtctttatt

SEQ ID NO: 13197 - DNA, 335 bp, Homo sapiens
ctgataaggagcctgagattcagagaggttcagtggtgtgttcacatagctgagactagaatccaggtctcctaactctcagtcttgccccctttctgccaatacagtgtctctcttgtatttctagatcaaggcaaagaggacactttgatagttctccccacacttgtgtgtccatgattgtgtgtgtgtgtgtgtgtgtgtgtgtgtgtgtgtatgttgtgggtggataatatgtaaatgcaagaactgtgatgtactcaactcagggtccagagggtgctgcagtgtggtgtttctcaaagtgtatctatggcttgtcaggttagggagag

SEQ ID NO: 13198 - DNA, 7910 bp, Homo sapiens
  misc_feature (3042)..(3042): n equals a,t,g, or c
tcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtttgtgcataagaaatttcagctcctatttgaaaaacctgttttttaaagcgaaatcagtgctgccatttatggttcagtgatttgggagagaaaaacaaaacaggaatatgcttgtcagctctgagtgtcctgcaagtcctttcacgatccagttcctgtttacctccaaaattatcccttttcactcgtctcctgacactttatatatgccagccatactaaacttttctcagaattcccaaattcgcccctttctctttcaattcttgctgtcagattcttcccacttctcactgtgcctggttatctccacgtcatttttcacatgtctgctccgacactgctgccttttcaggagcttggcaggctggttagtgctctagcttctgagttcccatccgtgtgaacttttgcctgccttcttgcctgtgtactgcactggggctgtgagctccttgagggtgagggctgtgttttgatcactgttagttcactgcctagttttatgactggctctgctactttcttgtgactctgagcaagttacttattactttgcctctccgttcatcattggtaaaatggatatagtaattgttcccacctcataagataaaaatcagttaatataaaacacccagaacagagtctgacacatgggaactacttaattcttgtccttatagccatagcatcaagcagtgagcatctactttgtgttggcaataactcagatgactgaataaatagcaatcctgtagaagaactgtttgtaccttacttagcatcaacactgtggattagttcaaacaattagtattaacaaagaaatgactaaaagatgtgtgtttagacaccaagaatagcatgtctggttatatgcctataacattgtcaccttggtagtacggtcagtatataaaggattatctttagagaaaaagatggttaaagaaatgccctaagagagagttatagggaaaacattctgttttaggagacattataaagggaagccaatgggacaggaagagtgagtcatctgcttagtaagatgagggtgaaagaatagtagaggcggctgctgtgaaagataatgtaaagggaacatgacattttcaagaacgatgtgggagagttttacaaagtagtaacaagttaaaggcatgcagcttcaagacacgaagtcatcaataccaaccaaaaaaaataagcctaagtggttcttaaagaaaaatctctttggtctggtgccagttctggaaaactttttttagtatggctggaatataaagtgtcaggagaagagataaaaggggtaactttggagaggtaaacaggaactggatcgtgaaaggacttgtaggacacgtcagagaaaatgagctttaaaagtaaagcttttagacatgaagctttactttcatgcataaagctactactttaaaaagtagtcacaagagattcattgtactatctagaaagaaaatgagatttaaaagtaatgctgaagatgcccacctttacttccctgcttgggttttaaaggagaggtggctttatgtacatatgaccctgctctcctggccacagcccatcagaacagaaatgtaccccaccccacacacctgggccagttatcttctctcctgggaacttggaaatgagacacagaactaagacagtaaaggttaggacagtaaagacaactaagcgttggggctcaaataatgttaattagaggctagaaaaaccaaagccacttaagaaataaatttttagaggagcaagaattaaaaacattgcaaagggactgaagtatgcaaagtaatatggagcagaaatgtgaggaaaaacagacgaaagaccaggcagacccaggtggaaatgtggatgaaagggctgcctgaaagccttcagtcccagtgaaggcaggctgaactgatgtggatgggatttcatgggattctatatttttacaagtgcctgtttacttaaactaggatgagtggacttctgcgtcttgcaataaaatgataccaaagaccaaagtattaaaacacataaacaccatcacgagcattaaagcatctgatgctacacccatcaagtctttaggtagtcggtcccttttgaacagtctcctggtgtcctccccaacaaagaaatcagaaaaattttcttccctagctctttgcagttggggccaagttttgtgacctaggctcttcctgtcagacacacacatagagttcaaatcagaaacgagcaaggtaaggaaacaggcttggtgggatatctgcttaagatattcagctctccactggttttcctggtgagagcagcggcagagcttctgggtttcagcagtgtgggttacaagataaaattccagagtagaaatggcatcagtgccagtggtgttagcagttatctcagactctactttctggcagcctcacaaactgaagcatctggtgctcagcttggactggcagcagtgagtgcttcccattaggccatttctcagcatgaatttgggatgttctgtcttaattccaagcctgtttgttccgcctcccaataattctatgagccactcagtctcctttaaagaaagttgtgttggccgggcgtggtggctcaagcctgtaatcccagcactttgggaggctgaggcagatggatcacctgaggtcaggagttttcagaccagcctggccaatatggtgaatccccatctctactaaaaatacaaaaattagcctggcgtggtggcgcacgcccataatctcagctactaaggaggcgnagacaggagaattgcttgagcccgggcagtggaggttgcagtgagctgagatcgtgccactgcattccagcctgggtgatacagcatgactccatttcaaaaaagaaagaaagttgtttcttaaacgtgccagggtagcttctgttatttgtaattaataaaatcctgaccaagccagcattttaaaccacaaaactgttcctaagaccagtccattacctctgtgagcgcaggaacttgatgcacccttggtgtttctagaacaccttgacaccaggactgtaagggttctaccatatttttatgtgagggggccgatacagttagccataaactgataaactaagaaattattctctgtctaggtgccatttttggtaggaagctttattattttccaaaataaagaatattatgctggcctaaaagaagaatttcgtaaagaatttaccaagctagaggaggtaattatttctcctagctatcatcagagtaaacgataactatatctaccctccttttcctcctattcttttctttatattcccactttccaagtcactttaaggtaattaggaaaattcccctaaacatttttgtttacagcagactgctgttataaagcagaaagctgtcctgcttaagatataaatcaaaacacctaaacagactttgtcatgggcttgcttttaaaatattctgctaatgttaaaataacaaggaaaaaggaaattgtacccacgtttccacaagtttttatgtatccagttttccatgcttgtttgcagtccttgtccatatatttaaaaaaaattaatatagctctaatcagagcatagatatcattctgtgtcctgctttttttcctgtgtccacttagtattacatactaaatatttcccaccagaaaaagtttgcaatgaacagtacagacacttgagggaagcccagatgtattttaccttcttttggggacagctgacatttgggccttggagtctgtctcttggccttgaaatatttcattcatgctaagcctgaagtttttactgacagaagacatagttcctgtctttcatgggaatgcattttaacattttatcagtaagcatgatgtttgctgtaggtttttcagaaacctttttttcattataaagttctcttctattactagtttgctaatttttaaaaaagtcataaatgttgaattttattgaatggtttttctgcatctgttacatcaattgaaatgttcatagaattttttcctcttaatctggtgaatatggtgctattgacaaatttttttttttttaatgtttaaccatcctagcattcctaagataaaacctacttgttctctatggatttttatatgtactgtagaattagctaatgaatgatttttgtatgtgtgttcataaatgagattggcctataaattttctactcttatagtatcattattggcttttggtttcaaggatattctgacctcataaaatgagttgggtaactaacctgtttttctaatctctgaaaccatttggtagggactagcggtttctttaaaacatttgagcctggtgtctttaacaggggtagatttttcattactagtttgatttctttaatggtaattggttttttggttttatatttcttcttgaatcagtgttggtacttttatatttttctgctgaacagtgtgggagctggaaagtaagatgcagtccatattcttcagataattagtttagtagtagacagaacacagtaggtagatataagcaatctaaaatgcatattatgcattgaaaaaaaactatggaggttatttataaagggcaaattagtttggtggtttaaatagccagataatattctcaatcaccccctttggcaaaccctgtaaccaattcgccttcttaaaatttcagaaacatacaatttgtgttttgttttcaaatgattgtcatctgtttagcagttaatccagtctatttccagtatattttaagtacaaatgcttttgcacttacaatggggttacatccaataaacccaccgtaagctgaaaatatcataagtggaaaatgcatttaataaacccaacctacagagcatcatagcttagcctagcctgctttaaatgtgctcagaaaacttccattagcctgcaattaggcaaaatcatcaaacataaaaccatcaaacataaaatatttataaagtgttgaatatctcatataatttatcgaatacctgcatccaaaagatgctggcaacacagcacactttagagcattggttgtttactctcttgatggtatggctgcccagcatcaagagttatcatactgcaaatcgatagcccaggaaaagagcaaaattcaaagttcaaagtagagtttttactgaatgcttgcttttgcaccgtcgtaaagttgaaaagaatttaaattgaaccatcataagctgcagactgtgcattttatattgaaaagttaatatttttaatttttaatgcagagaagtacccaaagcataaaaacacaacacgttttcacaaagcgaacacagccatggaaccagcacccatatcaactaacaaaatactagtttgggcttttttgtactttatacaaatggactcatataatgttcatcttttgggtctgcctgctttcattcaatattaggtttgtgggttcatctctgctgtgtgtagttctttcctgttctttatacagtgttccaaagtatagtatattacactttacccattctactcttgatagtaaacgttttcacatttgggctattacaaatagtgctgcagtgaacattcacataacatatcttttggtgaacatgtgttacattgccaagtacaattgctgggtgatgagtatgcatactcttaaaacatggttgtaccaatttacacctctacgacagtggttccatacccttgccaacttcattttgttcattgtaggcattctcttgggtgtatagtgttattgcattttggttttaatttgcatttccctaatgactaatgcagttgaacacctttccaaatgataattggccatttggacatcatctttcttgaagatcaagtcttgctcatttttccaatgggtcgtttgctatttttcttactgattcccaggaatcctttctatattctgaataccagtcctttgtattacaaatatgttgtactctgtgacttgttttatttttcaattttccagtttatgttgttgattgttttacttcatcccagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcaggttctgactaataagaagacgaccttctttggtggcaattctatctctatgattgattacctcatctggccctggtttgaacggctggaagcaatgaagttaaatgagtaagatatttgaatattttgtgcataatttaggatgacaggtggaatagtatatattgacctttctttataacagaagttgaaatatttaatacaactggtctgaatgagaacaagcagacaggggaatcttggactatcccaggcatgtcatatacctacactaactactctccatcactgcaatggggcaggggatttctgagacatgtagtaaagtgctttaaaatttattccttccttcctgattaaaaacccataaggggaaggatatggtagcttacgcctgtaagcccagcacttcgggaggccgagacgggtggatcatctgaggtcaggagttagagaccagcctggccaatgtggtgaaaccccatctctactaaaaatacaaaaattagctgggcatggtggtacacacctgtaatctcagctactcgggaggctgaggcaggagaatcacttgaacccgggaggcagttgcagtgagctgagatcatgtcactgaactccagcctgggcaagagcaagacacttcatcaaaaaaaaaaaaaaaattccataaggttgtaaatttttgtaaggatgttgttgcgggattgtacgaccagtgttacctcccatttaccgtaagatttccacattattttccaaattctgttttgagtttggcagccaccttgccttactccggcttcttggacgatagagctattcagggttacttttggtcataatctgggtgtagaataattaacatagaacattcctgattgtattccctgttcttattttaataaattgtcagtttctctctttgggcaagttctcacattaactgaacaaattgcttcactctagtctcattccttttgtgtaaaaaagggacctctatagtgtctttcaaattgaatattctattacaggcatttttaaatatttttaatgaaatatttaagggaaaaaagtgaaactgtagagtaataattacatatgggagactctgtgatgtcatcctagttgacctagctcacacctttcattttttcctcttcccacaggtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataatagcatgcttttatttt

SEQ ID NO: 13199 - DNA, 2575 bp, Homo sapiens
ctggcaacacagcacactttagagcattggttgtttactctcttgatggtatggctgcccagcatcaagagttatcatactgcaaatcgatagcccaggaaaagagcaaaattcaaagttcaaagtagagtttttactgaatgcttgcttttgcaccgtcgtaaagttgaaaagaatttaaattgaaccatcataagctgcagactgtgcattttatattgaaaagttaatatttttaatttttaatgcagagaagtacccaaagcataaaaacacaacacgttttcacaaagcgaacacagccatggaaccagcacccatatcaactaacaaaatactagtttgggcttttttgtactttatacaaatggactcatataatgttcatcttttgggtctgcctgctttcattcaatattaggtttgtgggttcatctctgctgtgtgtagttctttcctgttctttatacagtgttccaaagtatagtatattacactttacccattctactcttgatagtaaacgttttcacatttgggctattacaaatagtgctgcagtgaacattcacataacatatcttttggtgaacatgtgttacatttccaagtacaattgctgggtgatgagtatgcatactcttaaaacatggttgtaccaatttacacctctacgacagtggttccatacccttgccaacttcattttgttcattgtaggcattctcttgggtgtatagtgttattgcattttggttttaatttgcatttccctaatgactaatgcagttgaacacctttccaaatgataattggccatttggacatcatctttcttgaagatcaagtcttgctcatttttccaatgggtcgtttgctatttttcttactgattcccaggaatcctttctatattctgaataccagtcctttgtattacaaatatgttgtactctgtgacttgttttatttttcaattttccagtttatgttgttgattgttttacttcatcccagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcaggttctgactaataagaagacgaccttctttggtggcaattctatctctatgattgattacctcatctggccctggtttgaacggctggaagcaatgaagttaaatgagtaagatatttgaatattttgtgcataatttaggatgacaggtggaatagtatatattgacctttctttataacagaagttgaaatatttaatacaactggtctgaatgagaacaagcagacaggggaatcttggactatcccaggcatgtcatatacctacactaactactctccatcactgcaatggggcaggggatttctgagacatgtagtaaagtgctttaaaatttattccttccttcctgattaaaaacccataaggggaaggatatggtagcttacgcctgtaagcccagcacttcgggaggccgagacgggtggatcatctgaggtcaggagttagagaccagcctggccaatgtggtgaaaccccatctctactaaaaatacaaaaattagctgggcatggtggtacacacctgtaatctcagctactcgggaggctgaggcaggagaatcacttgaacccgggaggcagttgcagtgagctgagatcatgtcactgaactccagcctgggcaagagcaagacacttcatcaaaaaaaaaaaaaaattccataaggttgtaaatttttgtaaggatgttgttgcgggattgtacgaccagtgttacctcccatttaccgtaagatttccacattattttccaaattctgttttgagtttggcagccaccttgccttactccggcttcttggacgatagagctattcagggttacttttggtcataatctgggtgtagaataattaacatagaacattcctgattgtattccctgttcttattttaataaattgtcagtttctctctttgggcaagttctcacattaactgaacaaattgcttcactctagtctcattccttttgtgtaaaaaagggacctctatagtgtctttcaaattgaatattctattacaggcatttttaaatatttttaatgaaatatttaagggaaaaaagtgaaactgtagagtaataattacatatgggagactctgtgatgtcatcctagttgacctagctcacacctttcattttttcctcttcccacaggtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataatagcat

SEQ ID NO: 13200 - DNA, 10043 bp, Homo sapiens
ggctcaagcaatcttctcacctcagcatccggagtagccgagactacaggtgagtaccaccacacttggctaatttttatattttttgtagagatagggtttcatcatgttgcccaggctggtcttgaactcctgggtttaagcaatccgcccactgcagtctcccaaggttctgggattacagatgtaagctaccaagcctggccttgtgggtggattttaaggattccttaatatcttcataaaaaccaagaaactttttactcaaattagcaaaataaattgaattttatgttggttctcatatagtggatagtggacacaattcaattagttgcctcatatgatttataactaagatacctcttagccataaatggagtatcttattgacaattttgaagcatttccacagatttattcattcatttatatgaaatattcaaaacaaaaatatttactgagtccttatttgacactttttattttcttcagagcatttatatctatatagcattttgctcatttacatgtttgtttattactatgaacagatacacaagatcccacctttcgtgaagcttacattctaggaagataacaaacttgtaaataagtgagcaaagtaatttcagatacatattatcagttcaatgaagaaagtaaaacatgataatcatgtaatagaagctgctcagcaacttcagagctatggtcagggagggcctggggatgtgtgtttgacctgggaagacctgggaaaaggcaggcagaggaggcagaggaccatcaagtgcaaagactctaaggtggaaacacatttggcaaattcaaggaatataaaaaccgccaacgtgtaaaagaaaacataggggaaaagcttcatgacactggccttggcaatgatttcctggacatgacaccaaagaccaggcaacaagaccaaaaataaacacatgagactacagcaaacaagcttccacacagcaaaggaaacgattaacagagcaaaaaggcaacctatggaataggagaaagtacttgcaaaccacatacctggtaaggggttaatctccaaaatacataaggaatctctacaactcaacaacaaaaaaacctgattttaacatgggctaagatcttacatagacacttctcaggctgggcatggtagctcacgcctataaccccgaggcagacagttcacttgagcccaggagttcaagaccagccttggcaacatggcagaatcctgtctctacaaagaaattagctgggtgtgatggtgcacgcctgtggtcccaactactcgggaggtaggaggatcgctttagcccaggaggtcgaggctgcagtgagctgcgatcaagccactgtactccagtctgggagacagagtgtcaaaaaaaattaaaaattaaaaaaatagacatttcttcaaagaggatataaaaatgggcaacacatatatgaaaaagttcttatcactaatcatcaggaaaatgcaaatcaaaatcacataataacctcacacttgtcaagatgactataatgaaaaaagacaagtgttagcaaggatgtgtagaaatcagaacctttgcacactgttggcgggaatgtaaaatggtacagctgctatggaaaacagtatagatgttcttcaaaaaattaaaactagaactaccatgtgattcagcaatctcactactgggtatatatccaaattaaatgaaatcaagttctcaaagagatattagcactctcacgtagactgcagcactgttcacaacagcataatgtcaatgtccatcagcagatgaatggataaagaaaatgtgttaatgctattccacctaaaaaggaaggaaattctgcaatatgtgacaacatggatggacattgcggacattatgctaagtaaaataagccagacacagaaagacaaatactgcatgattgttcttaaaaggtgtatcaaaagtagtcagattcataaaatcaaaaactagaatggaaggaatctaggcagactcctaaatttggggtctgatcagctaagtggatggcaaagccagtgagaatttatccaaaagcacaaaagttgtttccttctcttcatagtctcctatgtgtctttcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtttgtgcataagaaatttcagctcctatttgaaaaacctgttttttaaagcgaaatcagtgctgccatttatggttcagtgatttgggagagaaaaacaaaacaggaatatgcttgtcagctctgagtgtcctgcaagtcctttcacgatccagttcctgtttacctccaaaattatcccttttcactcgtctcctgacactttatatatgccagccatactaaacttttctcagaattcccaaattcgcccctttctctttcaattcttgctgtcagattcttcccacttctcactgtgcctggttatctccacgtcatttttcacatgtctgctccgacactgctgccttttcaggagcttggcaggctggttagtgctctagcttctgagttcccatccgtgtgaacttttgcctgccttcttgcctgtgtactgcactggggctgtgagctccttgagggtgagggctgtgttttgatcactgttagttcactgcctagttttatgactggctctgctactttcttgtgactctgagcaagttacttattactttgcctctccgttcatcattggtaaaatggatatagtaattgttcccacctcataagataaaaatcagttaatataaaacacccagaacagagtctgacacatgggaactacttaattcttgtccttatagccatagcatcaagcagtgagcatctactttgtgttggcaataactcagatgactgaataaatagcaatcctgtagaagaactgtttgtaccttacttagcatcaacactgtggattagttcaaacaattagtattaacaaagaaatgactaaaagatgtgtgtttagacaccaagaatagcatgtctggttatatgcctataacattgtcaccttggtagtacggtcagtatataaaggattatctttagagaaaaagatggttaaagaaatgccctaagagagagttatagggaaaacattctgttttaggagacattataaagggaagccaatgggacaggaagagtgagtcatctgcttagtaagatgagggtgaaagaatagtagaggcggctgctgtgaaagataatgtaaagggaacatgacattttcaagaacgatgtgggagagttttacaaagtagtaacaagttaaaggcatgcagcttcaagacacgaagtcatcaataccaaccaaaaaaaataagcctaagtggttcttaaagaaaaatctctttggtctggtgccagttctggaaaactttttttagtatggctggaatataaagtgtcaggagaagagataaaaggggtaactttggagaggtaaacaggaactggatcgtgaaaggacttgtaggacacgtcagagaaaatgagctttaaaagtaaagcttttagacatgaagctttactttcatgcataaagctactactttaaaaagtagtcacaagagattcattgtactatctagaaagaaaatgagatttaaaagtaatgctgaagatgcccacctttacttccctgcttgggttttaaaggagaggtggctttatgtacatatgaccctgctctcctggccacagcccatcagaacagaaatgtaccccaccccacacacctgggccagttatcttctctcctgggaacttggaaatgagacacagaactaagacagtaaaggttaggacagtaaagacaactaagcgttggggctcaaataatgttaattagaggctagaaaaaccaaagccacttaagaaataaatttttagaggagcaagaattaaaaacattgcaaagggactgaagtatgcaaagtaatatggagcagaaatgtgaggaaaaacagacgaaagaccaggcagacccaggtggaaatgtggatgaaagggctgcctgaaagccttcagtcccagtgaaggcaggctgaactgatgtggatgggatttcatgggattctatatttttacaagtgcctgtttacttaaactaggatgagtggacttctgcgtcttgcaataaaatgataccaaagaccaaagtattaaaacacataaacaccatcacgagcattaaagcatctgatgctacacccatcaagtctttaggtagtcggtcccttttgaacagtctcctggtgtcctccccaacaaagaaatcagaaaaattttcttccctagctctttgcagttggggccaagttttgtgacctaggctcttcctgtcagacacacacatagagttcaaatcagaaacgagcaaggtaaggaaacaggcttggtgggatatctgcttaagatattcagctctccactggttttcctggtgagagcagcggcagagcttctgggtttcagcagtgtgggttacaagataaaattccagagtagaaatggcatcagtgccagtggtgttagcagttatctcagactctactttctggcagcctcacaaactgaagcatctggtgctcagcttggactggcagcagtgagtgcttcccattaggccatttctcagcatgaatttgggatgttctgtcttaattccaagcctgtttgttccgcctcccaataattctatgagccactcagtctcctttaaagaaagttgtgttggccgggcgtggtggctcaagcctgtaatcccagcactttgggaggctgaggcagatggatcacctgaggtcaggagttttcagaccagcctggccaatatggtgaatccccatctctactaaaaatacaaaaattagcctggcgtggtggcgcacgcccataatctcagctactaaggaggcggagacaggagaattgcttgagcccgggcagtggaggttgcagtgagctgagatcgtgccactgcattccagcctgggtgatagagcatgactccatttcaaaaaagaaagaaagttgtttcttaaacgtgccagggtagcttctgttatttgtaatttataaaatcctgaccaagccagcattttaggccacaaaactgttcctaagaccagtccattacctctgtgagcgcaggaacttgatgcacccttggtgtttctagaacaccttgacaccaggactgtaagggttctaccatatttttatgtgagggggccgatacagttagccataaactgataaactaagaaattattctctgtctaggtgccatccttggtaggaagctttattagaagccaaaataaagaagactatgctggcctaaaagaagaatttcgtaaagaatttaccaagctagaggaggtaattatttctcctagctatcatcagagtaaacgataactatatctaccctccttttcctcctattcttttctttatattcccactttccaagtcactttaaggttattaggaaaattcccctaaacatttttgtttacagcagactgctgttataaagcagaaagctgtcctgcttaagatataaatcaaaacacctaaacagactttgtcatgggcttgcttttaaaatattctgctaatgttaaaataacaaggaaaaaggaaattgtacccacgtttccacaagtttttatgtatccagttttccatgcttgtttgcagtccttgtccatatatttaaaaaaaattaatatagctctaatcagagcatagatatcattctgtgtcctgctttttttcctgtgtccacttagtattacatactaaatatttcccaccagaaaaagtttgcaatgaacagtacagacacttgagggaagcccagatgtattttaccttcttttggggacagctgacatttgggccttggagtctgtctcttggccttgaaatatttcattcatgctaagcctgaagtttttactgacagaagacatagttcctgtctttcatgggaatgcattttaacattttatcagtaagcatgatgtttgctgtaggtttttcagaaactttttttcattataaagttctcttctattactagtttgctaatttttaaaaaagtcataaatgttgaattgtattgaatggtttttctgcatctgttacatctattgaaatgttcatagaattttttcctcttaatctggtgaatatggtgctattgacaaatttttttttttttaatgtttaaccatcctagcattcctaagataaaacctacttgttctctatggatttttatatgtactgtagaattagctaatgaatgatttttgtatgtgtgttcataaatgagattggcctataaattttctactcttatagtatcattattggcttttggtttcaaggatattctgacctcataaaatgagttgggtactaacctgtttttctaatctctgagaccatttggtagggactagcggtttctgtacaacatttgagcctggtgtctttaacaggggtagatttttcattactagtttgatttctttaatggtaattggttttttggttttatatttcttcttgaatcagtgttggtacttttatatttttctgctgaacagtgtgggagctggaaagtaagatgcagtccatattcttcagataattagtttagtagtagacagaacacagtaggtagatataagcaatctaaaatgcatattatgcattgaaaaaaaactatggaggttatttataaagggcaaattagtttggtggtttaaatagccagataatattctcaatcaccccctttggcaaaccctgtaaccaattcgccttcttaaaatttcagaaacatacaatttgtgttttgttttcaaatgattgtcatctgtttagcagttaatccagtctatttccagtatattttaagtacaaatgcttttgcacttacaatggggttacatccaataaacccaccgtaagctgaaaatatcataagtggaaaatgcatttaataaacccaacctacagagcatcatagcttagcctagcctgctttaaatgtgctcagaaaacttccattagcctgcaattaggcaaaatcatcaaacataaaaccatcaaacataaaatatttataaagtgttgaatatctcatataatttatcgaatacctgcatccaaaagatgctggcaacacagcacactttagagcattggttgtttactctcttgatggtatggctgcccagcatcaagagttatcatactgcaaatcgatagcccaggaaaagagcaaaattcaaagttcaaagtagagtttttactgaatgcttgcttttgcaccgtcgtaaagttgaaaagaatttaaattgaaccatcataagctgcagactgtgcattttatattgaaaagttaatatttttaatttttaatgcagagaagtacccaaagcataaaaacacaacacgttttcacaaagcgaacacagccatggaaccagcacccatatcaactaacaaaatactagtttgggcttttttgtactttatacaaatggactcatataatgttcatcttttgggtctgcctgctttcattcaatattaggtttgtgggttcatctctgctgtgtgtagttctttcctgttctttatacagtgttccaaagtatagtatattacactttacccattctactcttgatagtaaacgttttcacatttgggctattacaaatagtgctgcagtgaacattcacataacatatcttttggtgaacatgtgttacatttccaagtacaattgctgggtgatgagtatgcatactcttaaaacatggttgtaccaatttacacctctacgacagtggttccatacccttgccaacttcattttgttcattgtaggcattctcttgggtgtatagtgttattgcattttggttttaatttgcatttccctaatgactaatgcagttgaacacctttccaaatgataattggccatttggacatcatctttcttgaagatcaagtcttgctcatttttccaatgggtcgtttgctatttttcttactgattcccaggaatcctttctatattctgaataccagtcctttgtattacaaatatgttgtactctgtgacttgttttatttttcaattttccagtttatgttgttgattgttttacttcatcccagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcaggttctgactaataagaagacgaccttctttggtggcaattctatctctatgattgattacctcatctggccctggtttgaacggctggaagcaatgaagttaaatgagtaagatatttgaatattttgtgcataatttaggatgacaggtggaatagtatatattgacctttctttataacagaagttgaaatatttaatacaactggtctgaatgagaacaagcagacaggggaatcttggactatcccaggcatgtcatatacctacactaactactctccatcactgcaatggggcaggggatttctgagacatgtagtaaagtgctttaaaatttattccttccttcctgattaaaaacccataaggggaaggatatggtagcttacgcctgtaagcccagcacttcgggaggccgagacgggtggatcatctgaggtcaggagttagagaccagcctggccaatgtggtgaaaccccatctctactaaaaatacaaaaattagctgggcatggtggtacacacctgtaatctcagctactcgggaggctgaggcaggagaatcacttgaacccgggaggcagttgcagtgagctgagatcatgtcactgaactccagcctgggcaagagcaagacacttcatcaaaaaaaaaaaaaaattccataaggttgtaaatttttgtaaggatgttgttgcgggattgtacgaccagtgttacctcccatttaccgtaagatttccacattattttccaaattctgttttgagtttggcagccaccttgccttactccggcttcttggacgatagagctattcagggttacttttggtcataatctgggtgtagaataattaacatagaacattcctgattgtattccctgttcttattttaataaattgtcagtttctctctttgggcaagttctcacattaactgaacaaattgcttcactctagtctcattccttttgtgtaaaaaagggacctctatagtgtctttcaaattgaatattctattacaggcatttttaaatatttttaatgaaatatttaagggaaaaaagtgaaactgtagagtaataattacatatgggagactctgtgatgtcatcctagttgacctagctcacacctttcattttttcctcttcccacaggtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataatagcatgcttttatttt

SEQ ID NO: 13201 - DNA, 808 bp, Homo sapiens
ccatcatcaacttaatttcacattctctctattgttggccctgaagaccagacgcacattacccgaaagctgggtggctgggcagactcctatttggtctccctgtctctaaccccttcaaatccttcctatcaaatcccatgttgggcacataggtggtgtcccatttatgtaattaaatactgtgtaggctgcatcagtcaattctgcctacaaggttgatgagtaataggtaagagccccactgagaaatagaaatgccatcttccacacatttccatagcccactgggttgctcactattcaatttttattatcacatcaccaccacgagaaggtaggtcggagagcaatcatttcattctatagatgatgcaactaaggtcccgaggttaagtgaggccttaaggtgctggcagaaagatcacacccagcgcactgctcttaccattggaatcagggctgtcggtccgctccaattgtctggtttcctgaacttattttcaagttcgccattgagagaaacctccgaatgactaattcttaaatttaagggtgcataataatcacctatggctcaccgctgcatttccgattcagcaggctggggtgggtagcgaagtctgtatttcaaatgagcccctcaacccaggtgacgcaggcggtgtggggaccgcatccggagggcgacctggagccgactgacttcacaaaggcctcctgccgcaaaccttcagcggccaccaaagccccggctgccggcggcggaccacctctgctgccgcgcgcctaccggagccgcttggcc

SEQ ID NO: 13202 - DNA, 267 bp, Homo sapiens
tttactgagtccttatttgaaactttttattttcttcagagcatttatatctatatagcattttgctcatttacatgtttgtttattactatgaacagatacacaagatcccacctttcgtgaagcttacattctaggaagataacaaacttgtaaataagtgagcaaagtaatttcagatacatattatcagttcaatgaagaaagtaaaacatgataatcatgtaatagaagctgctcagcaacttcagagctatggtcagggag

SEQ ID NO: 13203 - DNA, 808 bp, Homo sapiens
ccatcatcaacttaatttcacattctctctattgttggccctgaagaccagacgcacattacccgaaagctgggtggctgggcagactcctatttggtctccctgtctctaaccccttcaaatccttcctatcaaatcccatgttgggcacataggtggtgtcccatttatgtaattaaatactgtgtaggctgcatcagtcaattctgcctacaaggttgatgagtaataggtaagagccccactgagaaatagaaatgccatcttccacacatttccatagcccactgggtttctcactattcaatttttattatcacatcaccaccacgagaaggtaggtcggagagcaatcatttcattctatagatgatgcaactaaggtcccgaggttaagtgaggccttaaggtgctggcagaaagatcacacccagcgcactgctcttaccattggaatcagggctgtcggtccgctccaattgtctggtttcctgaacttattttcaagttcgccattgagagaaacctccgaatgactaattcttaaatttaagggtgcataataatcacctatggctcaccgctgcatttccgattcagcaggctggggtgggtagcgaagtctgtatttcaaatgagcccctcaacccaggtgacgcaggcggtgtggggaccgcatccggagggcgacctggagccgactgacttcacaaaggcctcctgccgcaaaccttcagcggccaccaaagccccggctgccggcggcggaccacctctgctgccgcgcgcctaccggagccgcttggcc

SEQ ID NO: 13204 - DNA, 808 bp, Homo sapiens; identical to SEQ ID NO: 13203

SEQ ID NO: 13205 - DNA, 1539 bp, Homo sapiens
cttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatat

SEQ ID NO: 13206 - DNA, 486 bp, Homo sapiens
caagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtctttt

SEQ ID NO: 13207 - DNA, 263 bp, Homo sapiens
cctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcag

SEQ ID NO: 13208 - DNA, 997 bp, Homo sapiens
tgttaatccaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccattgtgtatatgtaccatattttgttcatccattcattcattgatagatacttgagttgcttctaccttttggcaattgtgagtgatgctgttatgaacatgggtgtacaaatgtctgttttgagtccttgttttgctttcgtgcattctattaaaaatgttaaggttctttgctttttacttttttttctcttttatccaccttttgactttattcttaaagttttatcttggtataataatttatggtatgttgcagaattaggagcaaagtcccgtgtgtccttcactcagtttcccccaatggtaacatttttcataattacagcacaatgtcaagaccgggaaattgacattgatacagtccatatacaggtgtcccttggtatctgtgggggattggttccagaaccctcgatgataccaaaatccatggatgcttaagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtggttggttg

SEQ ID NO: 13209 - DNA, 997 bp, Homo sapiens; identical to SEQ ID NO: 13208

SEQ ID NO: 13210 - DNA, 997 bp, Homo sapiens
tgttaatccaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccattgtgtatatgtaccatattttgttcatccattcattcattgatagatacttgagttgcttctaccttttggcaattgtgagtgatgctgttatgaacatgggtgtacaaatgtctgttttgagtccttgttttgctttcgtgcattctattaaaaatgttaagattctttgctttttacttttttttctcttttatccaccttttgactttattcttaaagtttatcttggtataataatttatggtatgttgcagaattaggagcaaagtcccgtgtgtccttcactcagtttccccccatggtaacatttttcataattacagcacaatgtcaagaccgggaaaatgacattgatacagtcccatatacaggtgtcccttggtatctgtgggggattggttccagaaccctcgatgataccaaaatccatggatgcttaagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtggttggttg

SEQ ID NO: 13211 - DNA, 208 bp, Homo sapiens
tttttttttttttttttttgagagggagtctcgctctgttgcccaggctggagtgcagtggcacaatttgagctcactgcaagctctgcctcccgggttcacaccattctcctgcctcagcctcccgagtagctgggactacaggtgcccaccaccacgcccggctaatttttttgtatttttagtagagacggggtttcactgtgtt

SEQ ID NO: 13212 - DNA, 277 bp, Homo sapiens
tttttttttttgagagggagtctcgctctgttgcccaggctggagtgcagtggcacaatttgagctcactgcaagctctgcctcccgggttcacaccattctcctgcctcagcctcccgagtagctgggactacaggtgcccaccaccacgcccggctaatttttttgtatttttagtagagacggggtttcactgtgttcatcaggatggtcttgatctcctgaccttgtgatccgcccacctcggcctcccaaagtgttgggattacaggcgtga

SEQ ID NO: 13213 - DNA, 965 bp, Homo sapiens
agcattgtgttaccatagattagttttgactgtttttaaattttgtgtaaatgaaatttggcaatccatacttttctatgccttgtttctttcaatcaacaaaatactactgcatattatgtttttgtatgtatcagtagtcttcctcattttattattgaatagtagtcaattgtgtaaatacaccgcaatttatctatacacctacttttgaatgttgcttttttcccaagttttttcatattatgtataactaccatgaatattcattacaagtctttgtgtggacttaattttttaggagtaaaatcggtgaataatatagtaggtgaatgtttaatttttcagggaattgcaaaattatttttatagttgttataccattttatatctccaagagcaatgtttcatacttccgtttgctctctatttttgaaaaccattgatgttgttagtatttatatttatttttgccattctatgagtatctttctcaatatggctttaatttggattttgagagtctatagtctttgctgttttatgtgcttattggtcctttttatatttttctttgtgaaatatatttgtgaaatatttactgttaattaacctatatctaagcttttaacttaatatctttatacatatgtttgtatttataggcataatgcagtgctagattttcttaattataaatcatgtaagagtacaaattgtaagcatttgtagccaaaatattaggagtattttgtggtctactgtaataaaatactgttctgaaagtcactactgttattttccaacttaaaaaaatggcaattgtgctatttctgagaccaaaaaatttttgagttcagatggctctatgctgaccaacagatggatcaggaaatagcagatggttttatgagcagttctgtcatctcagcatctgaaatgctttacatgccaaggctatagaa

SEQ ID NO: 13214 - DNA, 962 bp, Homo sapiens
agcattgtgttaccatagattagttttgactgtttttaaattttgtgtaaatgaaatttggcaatccatacttttctatgccttgtttctttcaatcaacaaaatactactgcatattatgtttttgtatgtatcagtagtcttcctcattttattattgaatagtagtcaattgtgtaaatacaccgcaatttatctatacacctacttttgaatgttgcttttttcccaagttttttcatattatgtataactaccatgaatattcattacaagtctttgtgtggacttaattttttaggagtaaaatcggtgaataatatagtaggtgaatgtttaatttttcagggaattgcaaaattatttttatagttgttataccattttatatctccaagagcaatgtttcatacttccgtttgctctctatttttgaaaaccattgatgttgttagtatttatatttatttttgccattctatgagtatctttctcaatatggctttaatttggattttgagagtctatagtctttgctgttttatgtgcttattggtcctttttatatttttctttgtgaaatatatttgtgaaatatttactgttaattaacctatatctaagcttttaacttaatatctttatacatatgtttgtatttataggcataatgcagtgctagattttcttaattataaatcatgtaagagtacaaattgtaagcatttgtagccaaaatattaggagtattttgtggtctactgtaataaaatactgttctgaaagtcactactgttattttccaacttaaaaaaatggcaattgtgctatttctgagaccaaaaaatttttgagttcagatggctctatgctgaccaacagatggatcaggaaatagcagatggttttatgagcagttctgtcatctcagcatctgaaatgctttacatgccaaggctata

SEQ ID NO: 13215 - DNA, 997 bp, Homo sapiens
attctccaggctgacacattaatcaaagaaaatgtccatcccacatctttggtgtcatttttttaccttcttacttccttgcattaagaggcaaaagatccatatcaaattatgccatgtcttttgataaatacatttatgtgaaaacatataactcataactcttgatttttttcaccaaagaaagtagctgataataaaaaatgttccatttttcgtagcacaagctctatcaatttgagcttgttgatgcatttaagtgtgatgacattaattacactggcaaacactccaaaagcgcactttcttttatagcaaaatgccttttaaataaaatgttttcaaatctggcgaagaaagtttagaagggagataagcctcattattacttgtgattattataaatattaaacccttttatgtcataaattatagaaccttaaaaaagaattatcagcttcaagctaaatgctaaaataatttttcttcatagcaatatatctcaaagcaatgtgtgcataattataacttctgatatgttattagagctaaattttgatatgagaaatttttaaaactttatattttaatacaatttaagatttttccaatttttttaaatattgcatatttgatcaaagtggttgtgatttaagatgtaaaaattccccatttttggtaaacaaagtcttgtcaaaggatgagtagaaactacgtagctatgaaaaggttaattcatatattaggaacagttttactgcagaaaatttaaatcggcttaaaatgtttataccctcccactttctactgcaccaactctataatgaggtaggtcaattgagctttttacctgctttcaaaaatagcacaaaaatagttcttaagaattacgttgagtgagaatcagagattgaaaattatctgcaagaatatgtataacttccttctcccggcaccatcaaacgtgtttctctcctttattccccagattggttga

SEQ ID NO: 13216 - DNA, 997 bp, Homo sapiens; identical to SEQ ID NO: 13215

SEQ ID NO: 13217 - DNA, 758 bp, Homo sapiens
tcttttagatttaggatcttagcccatttacatttaaggttaatattgttatgtgtgaatttgatcctgtcattatgatgttagctggttattttgctcgttagttgatgcagtttcttcctagcctcgatggtctttacaatttggcatgtttttgcagtggctggtactgtttgttcctttccatgtttagtacttccttcaggagctcttttagagcaggcctgatggtgacaaaatctctcagcagttgcttgtctgtaaaggattttatttctccttcacttataaagcttagtttggctggatatgaaattctgggttgaaaattcttttctttaagaatgttgaatattggcccccactctcttctggcttgtagagtttctgcccagagatcagctgttagtctgatgggcttccctttgtgggtaacccgacctttctctctgtctgcccttaacattttttccttcatttcaactttggtgaatctgtcaattatgtgtcttggtgttgctcttctcgaggagtatctttgtggcattctctgtatttcctgaatttgaatgttggcctgccttgctagattggggaagttctcctggataacatcctgcagagtgttttccaacttggttccattctccccatcactttcaggtacaccaatcagacgtagatttggtcttttcacatagccccatatttcttggaggctttgttcgtttctttttattcttttttctctaaacttc

SEQ ID NO: 13218 - DNA, 758 bp, Homo sapiens; identical to SEQ ID NO: 13217

SEQ ID NO: 13219 - DNA, 1060 bp, Homo sapiens
ttctacagcattgaaaatcaaataatctaaaagaaaaaaaacaaacaaaaaaataattaactgaggagaaaagacaactactatcagagaacaggtcataacaagatacttcttttccccaaagccattgctagctagtatatatatattccctttccctgtagtttgttccaaatttcaagtgtgatgatagtttatttgcacaaacgagacagacaaaagttattctaactagaatgcatgctctctgagagcaagactaatacctctgattcttttagagagcctaggtcatgtattttgggtgtgggaggccagattgtgccacccccaaatatgaagtattactgagctaaagacaattaagggaagcaaatgcaggaaagctctctactcttcctctctttgtcttaaagcaggacatagatttataaggacaaaaggcatcccacccctctttctccaagtagaacaaaggttaaccactaaagacaacttttgaccctgattgtctagagatggtactggaagaattttcatgcataagtttcactaaccagcctttatctgccattgttttgccttctcacaacttgctgctcctgggagactcaaagttcttttcctttgtcttgtcacttctctaaaatgtactgttctttgttgaagatgttgttgggacaactaagtttctcctcaaagactcaacctcctggtcataagttgcaaaagttgtaaatcagccctacccactttcttccccaccttcttcttttcacaaatcacatgtttaccttatttggaaaagtttaagtctcagccaatcaggatcagcttagattgtgtggtccaaccccagccaataggcaaaggacacagaaacaggaactgcactagggttaaaagctccttcctcctttgttcagtgtgctcttgtgattgcatcaggtgcaagtagtacccttctgcagaagtaaagttgccttgctgagaaattttctgtctgaatgcgggtttcttttggctacactgagcacttgtttccaacaatgctatataa

SEQ ID NO: 13220 - DNA, 1060 bp, Homo sapiens; identical to SEQ ID NO: 13219

SEQ ID NO: 13221 - DNA, 1060 bp, Homo sapiens
ttctacagcattgaaaatcaaataatctaaaagaaaaaaaacaaacaaaaaaataattaactgaggagaaaagacaactactatcagagaacaggtcataacaagatacttcttttccccaaagccattgctagctagtatatatatattccctttccctgtagtttgttccaaatttcaagtgtgatgatagtttatttgcacaaacgagacagacaaaagttattctaactagaatgcatgctctctgagagcaagactaatacctctgattcttttagagagcctaggtcatgtattttgggtgtgggaggccagattgtgccacccccaaatatgaagtattactgagctaaagacaattaagggaagcaaatgcaggaaagctctctactcttcctctctttgtcttaaagcaggacatagatttataaggacaaaaggcatcccacccctctttctccaagtagaacaaaggttaaccactaaagacaacttttgaccctgattgtctagagatggtactggaagaattttcatgcataagtttcactaaccagcctttatctgccattgttttgccttctcacaacttgctgctcctgggagactcaaagttcttttcctttgtcttgtcacttctctaaaatgtactgttctttgttgaagatgttgttgggacaactaagtttctcctcaaagactcaacctcctggtcataagttgcaaaagttgtaaatcaaccctacccactttcttccccaccttcttcttttcacaaatcacatgtttaccttatttggaaaagtttaagtctcagccaatcaggatcagcttagattgtgtggtccaaccccagccaataggcaaaggacacagaaacaggaactgcactagggttaaaagctccttcctcctttgttcagtgtgctcttgtgattgcatcaggtgcaagtagtacccttctgcagaagtaaagttgccttgctgagaaattttctgtctgaatgcgggtttcttttggctacactgagcacttgtttccaacaatgctatataa

SEQ ID NO: 13222 - DNA, 1221 bp, Homo sapiens
aaccaaacaactatcaagcagtagtaatctatctttaaatttctactcggtcatgcaagtaaaaatgccatcacgccttcaatcccaaaattcccaaattcccaaatgtaaaaaagtccatgcaacaaaatgagaaataagaaccgttacaactgagattactggagtctcttccggaagacaaattatcactgtaatatgtaatatgaacatgtgaaggtctggctcatgttttatgatacacaggcttcaaaagttgtatgagctcagatagagactgtgtttgcaatttgttctttcactaattagctatgtgatttagttaaaaagtcaaaaagattgtagtaacgattaaacaaatgtgtggaagtttgacctagcagtgtctgacccactcatgatatatatccaaccaatactagttagttctgattaccttaaaactggctgctcaacttacaaatcttaggtcaaatcacaggccctctaacgactacatataagaaaaacctatcaccaacgatcataaggtgccatatcaccaaggatcttctatgccatgcagacccaatcaatacaaggcagaattgatttaatacagtgtttctctaagtatgaataggcaggtatcctaatcattaagaaaaggtgctttggaagcagaaaggctgcgttcaaattctggctctatcacttaccatctacctaaatttaggcagttcttttattctctgagcctacttaacttatctgtattattcctataccccactgagttattgtgaggattaaataagtacagagaaagtgtgtggaaaagtgcttcaataagaatgttagctattgccactgctattattatgctccctaaagaatattccatgacccaataaacaggaaacactgctagagagtcacatgtgttattgcatttgacatcctgaggaaaaaaaaaaaccctatttaatcaaataattcttaaatttatttaactctggcatccttttctcaaataacattaactactgtggtagtaatgtgccgaagaatactcttaagtgcaatgaacactataaattttctataaagctgtatatctaaacataccactgtaccacatagcctatttctagtccattccagatgcaatcaaaatttccctggcctcaaaaattagaagactaaaactttcattacctcttgttcagaaggattggttga

SEQ ID NO: 13223 - DNA, 18138 bp, Homo sapiens
gctgctctttggtgattcccaacttcttatgagtaaaagtacatttgtaaatacctgatagaaaagaatgtgacaaattttataagttaacaccataaattcatagaaatcatgaaaataatatatgtatacgaaatcccttgataatctgtgtagtacaagtttttcccaatcaatgcctagaataatgatgttcttacatatgaatcagaatgatttcagcctttatcatcaggccagatttaaacaccatgacatatttatcctgtgttcttttggtttaggagtacatttaatgatagcataacataagaagcttatcagaaccaggttcaattcttattgtgcagcagtaaggttacagaatggccttctattctgaaacatctaaatatatatttcagaaatcatactcaaggcatctatttcaaagggtatagtataggtacagtcaaaatataagtcctacacctttattcacttcttcagcaaatcaaactcaacatgtttgaaatttaataactgaattcaattccacaaaatccttccctattgtctcacctatttactcaatcttcaagaccccacttgttacatctatccacaaagccttcatttggtaaactgagtacatttccgcctcattctctgaatgcttttgagttctaagtgttttgtatataatccaaagctttgtgaaataccatcccccattattctgttaatgtgcacatgacttatatacccaaagagtaactttattgggcacctactaaatgcttatttgctgagcactatgcttgttactttccctttgtttcagtgaagtctcacaagaatcctaaaatgacgttagtctcatcctcattggataaataaacttttcaaagtcacctcaagaactgacagagccaggattagagccagggctcaaatttctactatgccaaactcctgctcaaaaagactttttttttaagacagggtcttgccctgttgctcatgctggaatgcagtgacacgatcatgggtccctgcagcctcaacctccctggttcatgtgattctcccacctcagactcccaagtagctgggactacaggcgcatgctaccacacctggctaattattgtatttctagtagagatggggttttgccatgttgctcaggctggtcctgaactcctgggctcaagtgatctacccaccttggcctcccaaagtgctgggaatacaggtgtcagccactgcatccagccaagaagacaaacttctttctgcacaaaagattcatgcgatatccctagagtaccttccatgtctatagaggtccacaataaatacttgctaaccattcccacaaatatttactgagcagtttctgcaggccaagcactacattaggtgttaagaatacatggatgaataatataatttttcttaaaaattaacaaagaaccaggcggtaatcccagcactttgggaggccgaggcaggtggatcacaaggtcaggagttcaagaccagcctggccaagatgatgaaaccctgtctctacaaaaaatacaaaaaaattagccatgcgtggtggcaggtgcctgtaatcccagctactcaggaggctgaggcagagaattgcttgaactcgggaggcggaggttgcagtgagctgagatggcaccgctgcactccatcctgggtgacagaatgagactccatctcaaaaaaaaaaaaaattagcaaacaaccttaaattaaataaaaaatgaacctgttaaatgtttttgtgactctatagctatgcctattttattagtgcagcagacccctggcattttcagattggacttctataactttaactatatataaatgatttcagagtttcttagtaatttgtaattatgctgagagaacagaatgtcctataaggttaacatgcttcatcagcatatcacttagccacaaaatatactaattaagacttaaacatattagaaaaccagctcctatcacttaccacttatatgatcttgaatcacttattttacctctctgagcctcagtttccttataaaatagaaacaatagtacctatttaattgaatttggggaagaataaaataacataacgcagagaaaatactttgcctcttacaaattgagtatcaaataaacctcagatattactactaagaccagtatcagcatttccagtagctttgtttgcctctctcactttgtaccattttatggggaaaactacatgctatcatgatattcgtaaagctagaattcttaaatatcttattcctttataaatgtcaagattctactgcttttgctaaacttaaagagaaaagttatattatggtatttatcacatcattcttcaattatgaaatgctatatacacgaaaggagagtataattgttttatagattggaaaatttatttgcatgataaaatagcatcaaatgacattaaattttcagctacctaaaattcccatgaggaccgcaggttccttggatggaatttgttgtaagaagggtaggatatcatcaagtacaaaccacttatccaagtattccaaaatctttcctaagcacactaatgaatttacacgaacctattaaaagaggtaaattgcattagtcattaaaagttttcaaaatctagaacaaaatatttaagtgtaaacttaatcttcatataaatatgttaaagtctcaagaataaatgtagatttagaagctctcatcctttatcaacataggaaattcacttatttactaattttcctggcttgtttcacaaagaatttatgattgcttcaccaggtcactagtgagctaaagtcaaggaatgactacaatcttgtagcattttaaagtgattagaatttgagaaacttttactacattatgtgttactatcataagaacactcctttggggacatttgaataataaaaaggactacattctttgcaccaagtgatcattttcacccacattccagtattttactctaacttgggttcaattcatttttaaactaaatattttaacatgtgaaggtatccatatatgtgttttctatttccaaatatacagttattaagacctcttatttagaagcttttatcaaaattccatatgcacttgactatttgataaatacatcataccctacttctatttggaatttcttaagatagaatatctttaagtcaggactatagtattaataaaactccagttttcaaaaaacagtaaaccaacaaaggcagaaaataattttgttggctaataaagcaccatagttctacaggaaaaatggggaaaaatttccatttctaaaaaacaatgtacaattgttttctgaaattaaaacacaagagatattataaattcaaaaaggtatctgaacgcttaacttgtactcataattcgttttataaaaggaacagctgcattctactgagatatatatatattttaagcaaaaccgagaatactaattttatttacttttaggatatataaaatattagtcatgtaagtaatgaataaatatagctcttggaggattttacctaactctgtgtagaatttttaaaaattttattttcagggaagagtattaagacacaatactaactcacgactcaggaatttcctagtcagaattttaaacttttagagatagaggactatgaatacaatttgggaattcctatttgccactctgaaggtaggcagaagcactgaaagtactatctaaaatccacttaaaaggtgacatataaaatgtaaatccattcctagttactgttctaaatataaatacattcattataacttcttgtaaacaacatgccttaacggccagttggcatcttaaaaagaaacatacatataactgggcagcaattcacatcatttaagtatccatgtttcccatttctacatacccctacatatgctcagaactgaactagaacaggtactcgctttgctttggttttggattttttttgggcggggtggggagcggcgggggcttgctctgtcacctagactggaaggagcagcacaatcacaactcactgcagcctcgacctcttggtctcaagtgatgctcccaccatgccaccacatccagctaaatttttttatttttagtagagacgaggtctcgctgtgttgctcatgctcgtcttgaactcagtgctcgagatccactcgcctcagcctcccaaagtgttgggattaaaggtgtgagccaccatgcccggcctacaacatgtactttgagaaaatgtatgttaatataaatttatgctgccataaaataaggtacatagtatgattgtaagatctttaaaagggcattttgaaaactaaattttaagctgtatattactaccatctattttaaaaattcaattgtaaaattgagaattttagagaaaacagctacttttaatgatagtgaagactcagagaggcacagtgacttttcaaggtcacaggggttgttagtaacaaagtgagaataagaactaaaacttgactttatttcatttcatacttgtttgtttcagtaatgatttctttttctactttggtgttacattttccatttcaaagcctttcaaccaagaaatgaactaaaatagattcaatggctataagataaaatcatatcattcaaattacttttgcttataattttattaagctgtttatttttatttaaattcacattccaccagataaagacgggatctccagagaactagttttacaaaatgcaaatttaataatatgtccgttatcaaaaatcaatatcaagaactggtcaggcaaaagagaacatttctccctctttaaagctgctattttgaagacagcattcaatattacttctataaagaaatataaatgtgataaactattatatttagtgttagagaaaaggctggggacatttattgctttcaatatgagataatgaaaactttgttattaattctaccttccttgactaacaagtaactgaatgttaaaattttgtattcaaagaaggtaactatttccttggtctacattttttagcacaactatttatcctacttgtattcacattaatttattgctttcttgtactctacttttttaagaagtgggcaagtcagtgagaaataagacatttagagaccaataactaaaaataaaggctatttataaaaggaaacttttcaacaagtttttacgcttagataccaagttaaactctcataatatttttaaactaacaacaaaataaattcagttaaagcagaaaaggattaagaaaaaaataatcacccaacttttttactgaagcactcaaagtaaagggacagcaagtaaggttaggaatgcaatattataaattatgtatcaaagaaaactacagctcatttttatagtactatatacaagttatctacagccaagatgaaatacatcaacaatctataaaagggttattaaacaataagaaaatgatttaaagcactgacaagtgaaaagaaaaacaaaaattaatatgcaattacttaccgcaagggaagatgtttgtagacaagcatttttaattcttggtatcaaagcgtttttcatggatgggtagtctataagatttgcaaaggttggaatgatgtttagacagagctcctataaagaaaataaactgaatcaatattagggaaagactcatcttttctctctgatattacaaagttttgcatttgcatggctaaactgtcatatagtttgaaacaaattttcatatatattatttggtcctttcaacaactctttgaaaaatgaatggttataatcacttttcagtcttacagatgagaaaaaaagctcagaagacattactcaaagtcatactaggtcataataactagtgtatgacatccaaactccctgatctcattcctaatctctttctttgataacacaagtcctcgtttatctttaaataacaacacataagttttgctatctctcagaagaagggaaaatcaagtatgaaatcatgtaaaaatactcctctcaagtaattctcttagctgttacatatatccatatgataacatacaacagttttttaaaacaacataccgaaaggagtgtttaatttttttttttttttttttcttgagacaggaccttgctctgtcacccaggctggagtgcagtgacgcaatcatagctcactgcagcatcaacctcccagtcttgtgggatcctctggcctcagcctcctgagtagctgggactacaggtacacgccatcatgcccagctaattttttttttttttttttgagacggagttttgctcttgttgcccaggctggagtgtagtgacatgaccttggctcacagaatcctccgcctcccgggttcaagcaattctcctgcctcagcctatccagtagttgggattacaggcacatgccaacacacccagctaatattttgtatttttagtagagatggggtttcaccatactggccaggctggtctcaaactcctgacctcaggtgatccacctaccttggcccatgcccagctaatttttcaattttttgtaaagacaaggtctcactatgtttcccaggctggtctcgaattcctgagctcaagcaatcctctcaccttggcctctcaaagtgctaagattataggcatgaaccactgagaccagccttaaaagagtgtttaataatttttagaagaaaattgaggacagagtattacataatcccaattcttttttttttagttttctttttttttttttttttttttgagacggagtctcgctctgtcgcccaggctggagtgcagtggcgcgatctcggctcactgcaagctccgcctcccgggttcacgccattctcctgcctcagcctcccgcgtacgtgggactacaggcgcccgccaccacgcccggctaattttttgtattttttagtagagacggggtttcactgtgttagccaggatggtctcgatctcctgacctcgtgatctgcccgcctcggcctcccaaagtgctgggattacaggcgtgagccaccgcgcccggccctttttttagttttcttgggtttttttttcttttttttttttttttggagagtcttgctctgtcacccagggtggagtgcagtggcaaattcatagctcactgtagcatcctgggctcaagtgatcctcctccccaactcagcctcccaagtagctggcactacaggcatgcactgccatgcctggttaattttatcatcttttatttttggtacagacagggtcttactatgttgcccaggcaggtctcaaactcctggcttcaagagatcctcccacctcagtcttccaaagtgctcaaattacaggtgtgagctaccgcacctaatcccaagttctaaaatgtgtaggtacctgtgtctatccataggtttaggaaaaaagactagaaggatatatatgaaaatgttaaccatcgtcatctgtgagagcgaattttaatttcttttttttgttatttgtaagtacttccaaattctgaaacttaaagcaagcataactcagaaatgggggaaaaaaagatttaaaacattcttgttaactaatgtggtgccatagtagaaatgataactggcaaattctgggaataacaggaaaacagagggatgactgggggctagggaactaaatgagaaaatgaaaagaagaaatggcttgagaactaactggctaaagtacacacatctcaggcagtttatgagagatgatccttgtagcaaagcataagagaagggatcactgaggaaaacggaagcacaaatgtgaattaggaaggatactactgaaaatactggcaaacttcaagacatccatttatagttagaagacagaaataaattaactactaagaatctgttatcagaacactggatatattttatttgctttaacttattcttaggcttccaaaaggcaaatgtaagagagttaattgtttgtatccactcagaactattaataattaagtgattgataaaatttaaaaatgagccaggcatggtggtgtatgttcctgtggtccctgctactatggaggctgagggaggatcacttgagcctgagagagcgtgggaggtcaaggccacagtgagctaagattgtgccactgcactcaagcctgggccactgcactcaagcctgggcaacagagtgaaagcctgtctcaaaaatatataaattaattaattaattaaggaccacagatgggagaagagaatgggcaagtgtaagcagtcagtgggacactatgttcctatgttcccgtaaggagcttccttacagaagatcaggctttaagacagagagacagagataggcagacttacaggaaaggaccccctaacacctgtattattaaaaagcgactggaaagtgccatgctgtccaatcaaagtcatagcaggaggttacaaagaggcaaatcttaaattctgtctaaatcacttagctaacatagggagagctctctcccgaagaggagacaggatgaggaactttatttatttatttatttatttatttatttatttatttatttatttttgagacggagtctcactctgtcgcccaggctggagtgcagtggcacgatctcagctcactgcatcctccgcctcccgggttcaagccattctccctgcctcagcctcctgagtagctgggattacaggtacccgccaccacacccagctaatttttgtatttttttagtagagacggggtttcgccatgttggccaggctggtcttgaactcctgacctcaggtgatccgcctgccttggcctcctaaagcactgggattacaggcatgagccaccgcacccagcccgggatgaggaacttaataacagccgggatgaggaactattttaataacaggagattgcaaaacacaaaatcaaacctcaaaggagtctaattagcaaactctcagaaacttctgtttattttacactttataatgggtggtgggtggcggtgatgaagataatttcgatatccatttaaaaggtaaattaattttcaaaaattgtgtctgatacacgtttataatgcctctttttaagaatcctaccttttgcaaaccatcttctacccgtccaaatgttttcagaaccatctgtagcctcttaaatatttctaatcaaacttagctttaaaaatttcaatttaaaaatgaatttcagatgttactttctagcctactatttgcaagaacctggaggaaaagatttcttatttcttgctttctctaggattctcctaattgtttagatatgctttatcaactaagcagtgctaatttcatgactaaagacttacactgaatgataccagaaatgctggtttccccaacctggccaacatggtgaaaccccgtctctactaaaaatacaaaaaaaattagccaggcatggtcgcccatgcatgcaatcccaggtacctgggaggctgagacacgagaactgcttgaacccaggaggcggaggttgcagtgagccaagattgcgccactgcactccagcctggaaaaacaaaggaagaaatgctggtttccaaatcttagcaaagttacaaaagtcaatctgaattatatactacttcaataaaatacttgctgacacttattggtcaaattaactataaagaaaaatggatttcatgtcacttaatcttcccctccctcttctttaatatcactaaatataaaacaagtttggctgcacagagcctgtgggaatgttttgtgaggctataattcacaatttctttaaaaagaactaagaaatagaggtagacacaccttccccactcatccatgtcatttggacaaaggcagcataccctcacctttaagaaggcaaatctaattataaggaaaaaaatgttaacatcaacctcacagccttgaacaaacgaaataacttagcagacaaagactgaattaagtccaaaaagtgaccttaaatatgtagtattaggttcatattaactttagagtaaataacttaaaaaaatcctattttattaaaatgtttatactagcagagactataagcttttactacaaaaccatcctgcagtgagatgttcttaacataagtatgtattttcaaagtgaaaaaacttaaattacacttttaatagtgatccagaatttctttcagacaaagaactcatagaaccaaaattttaatcgcaaagactacaaaactaacagtctggcaaagtatatggtgttttaagatggcctttgtggaacaaaagttataactatacatgcattaagaatggtcacactaaattactgtctgcttttccatctacctgctgtacaaattaacttcattgcagaagaaacagcatctctacatagaaaactgagttaccaagcaagaaggaaaattatgagtatgggaaaatacctactcaatgttttcatgagaaaaaggcacacgtggccacgcccaatggctcaggcttataatcccagtactttgggaggctgaggcacgaggaccacctgaggtcaggagttcgagaccagcctggccaaaatggcgaaaccctgtctctactaaaaataccaaaaattagccgggtgtggtgacaggcacctgtagttccagctactagggaggctgaggcaggagaattgcttgaacccaggaggcggaggttgcagtgagccgagattgtgctactgcactccagcctgggcgacagagcaagactcagtctcaaaaaaaaaaaaaaaaaaagaaagaaaagaaaaaggcacatgcatcttcggaatttttgttcataattatcagtttagaaagaagcagaaagatgaaggtatacaataatacaaactacaacatatcaaatcttcttccataatagtacatttctgataaataaaagcaacaaatctacctcataatgcaggtattatgtacacagactgattacttttttcacttacaatacactgattctttaaattagttaggagtgaatatattttagttacagtatatcaataatgtgattcaaaagataaatatatttactattgagttatgtattttatgacttaaatccaaaatgtactttatacctcttcttctgctttaagaatcaaaatcatcattaaagaaaaacaaatcagatactgtacctggatctgaatggaaggagcttctagtgctctgtaaaccatgggtagaacactgttctttatctcatcaggaggggttttggttagtagcaaatccattttttgtaggaaaattaacaaaatctgtttagaaaacggaaacaatgtattaaaacctggaatctttaaaagattcaatatatgccaaatgtaaagcttcttcaaaagaataactcatatattttgacactcaccatgttgctagcctgaatgcgtggaagacaaaaacacacaaatcaagtctcttacatttctggaggcacaatatttaacatctgctctgagtttaaatgttaattaaataaagactaatctcctctcacatatctacagtaatctatcacttgcccacacataccaactatctggaaagctacagggtgaaaaaagccagtaaagtgagatatcccaaagaagtaaagtccatcacttggcttctatgaagctcaagagaaaaagaaagtacagaactgagagggagtataagaaaaaattctagacgccaggtgcagtggcacacacctgcagtcccagctatttgggcggctgaaacaggggaattgcttgagcccagaagttaagtccagccaaggcaacatagcaagaccctatctcttaaaaaaattttttttattttagaaaaaaatgtttttaagttgtccctggtcattcttccacatacctaaattataaggaacatactgccccttctatttatacagaaattagttttgccaagactcagggaagaatattcggaagaaattttttctttttttttttttttgagacagggcctcactcactctgtcacccaggctggagcgcagtggcgcgatcatagcttaccgcagcctcgacctcccagggctcaggtgatcctcccacctcagcctcctgagtagctgggaccacaggcaggcacctggcttatttttgtatttgtttgaagagacagggtttcaccatgttgcccaggctggtcttgaactcctgggctcaagcaatctgcctgctttgacacgacaaagaactgggattacaagcgtgagccactgcacctggcccaaaaggtatttttaactggacaactaagagaaaaaagaatggaggcaaataagaattcagattataggatccttagggtactatcttgactgatgcatagcttagggaacagtggctccaccaactttccctcatgacaccttgaccatttgggggaaccctgcttcacaggctacagctccctcacttgttctttccctaattcacagaaattctcaccttaccaccacatacttccttctgttcccctcctttcaagggaaggactacaaagaatcataaaaccattaaattagatagttgatatataactaataagctattcctatacaatgctacaaacatgtaataatacctgctatgtgccagaaaatttcatttaatctcaacaatccttttcattttagaaatgaggaaatagaagctttaagatggcaacgacacaagtcatacttcaagtaaggagataaagaagccccaattcaacccaggtgtgtgactctactgctcttaaatccaacattaccttcaatctagcaaatatatattatatacatgagagactgattacttttttcacttacaatacatatacacattattcccatggtgctgtaagcattttcctattctagtggaagtagttattagcaataaaatggagagaaacaactggcacaaagcacctacatattaaagacttaaataacaaaataatcaaaaatacttcaaatacttcaaagtgcaagagaaaaacaagtatttattttcctaaacctgtaactttctacaaagtatatatatggtacataaagaacagtataacacatgcaaaatttcattgcagtttatcttctgagatagtaacttatggagagctacagacatttaactgcaaagttcaatcataattttaaaaatagtttggttcaaacatgtaaagcagctttctgactaatggaaaagaaagtctcatacacttacctcagttttttttaagtcatatattcattccttttgttttcagtgatagtcacaatcataaataacagtagataaatacacaaaaatatctataacatacctggattggctcctgctgcttaaacacagggccaagttcaggaagaattaatttgacatattcttctttggtgcattcctcagcaataagtagaacattgggcaaaacaaaaggtaccatgtcagggtttacaaattctgaagtcaaacaaggcaaaattctctgcacaatgacacgctgaaaggcaaaaatgttttttaaaaaaaaaataaaatttattaaaggtttttagtattagttaacactaaggtctaaaacctctaatccctttaggtaacgtgacgatacaatttatggttgaaactggtatattttcagagtaaagtgggatgctattgctaattatgcaaggataaatagcataaactggaaaggtcatgggtaaaaggggacacacggtcaccctacctgtaggaaacttaccctaattagtctccaccgctatgtttgtttttcctcttgattccttcattacttacgattcataccacacaacataaacactatcatgtactgttaactgtttcacacgttaaccctagctacacttactataagggcctgagagcagggacagtattttatgcctcctctttactctccatagcatctaagtaaagagtcagacaaacagtaggtaactaacgaatatctgatagattaaacactggaaatgtttttacaaccaggaattattagtattccaaccagtgcctcttcagcattcaccaacattttaaaaactgtattacactcatcatttaataagtcagaaaaggagtaaaggaattggaaaggctaacatcaacagaagtacccctttaactgctggtgagacaatgaactccacatgatagcttatggactcttcttctgacctttaatatccaactgctgtctctgcctagttagtatccttctaaattttttagcctatttatttttggaccacgcaaaaaaaggtccactgaacttttggcttcagttggcagtgttttatagtcatttatgtacctcaggcaaagttatattattttcttggaagagttatggtagtaagtcaaaataaactttaacttctaaaatcctgattattaataagaaactaacaataacaaaccttgggcagttttggtagaacctttggcagtcctttgaaaaactgtgatttctgaagattatctctttggaataaggtatcaaaatattgcagtgttactgcaccaacatcatcaaagaagggaatctaaaaaaaatggaaataaagtattttgataaatgttaaattgaaagtacttctcatatctgaaactgtcacaatatggtaaaaaaaatactcagaaacatttagcaaaatgctgaagatcaccttagaaattctaattataaaactctgaataagaaaataaatgatttttcaagttcaaatctttggaatctgtacctgtgaattggctgggtaaaaactttcttttatgtaagtctaaaatattgaaagattaaataaaataatttgaaggcataaaaataccagttattagttaaaatccatggttggcccgggcacggtggctcatgcctataatcccaacacttcgggaggccgaggtaggcagatcacctgaggtcaggacaagaccagcctagccaaaatggtgaaacactgtctctaccaaaaatacaaaaattagccaggtgtggtggtgggggcctgtaatcccaattacttgggaggctgaggcatgagaattgcttgaacctgggaggtggaggttgcattgagtggagatcgtgccactacactccagcctgggtgacagagtgaaactctgtctaaaaaaaaaaaaaaaaaaatccatggttatatgagtgaaataaaggactatgaattctctaagagtctagaacatctgtttacttaattgtgactgttagcactctgcttatttgaaatcttaattttctatcagagcaattacgtacatatttagctgtgtaagattaagcaaaattgaatatttaatacactcaaggatacagatgttatttggggctgtatctgactgttgctttagaagaacttaatctcagaacagggatccctggggaaaaatatttttttaaaacccaaaaacttaatctacttcaactcattttttgttcctccatcttaggcagaaatccacatgtactcacctttgtcatttgatctgcatctggtcttacagtcggagttacatttaacagtagctttacatgttcacgaacttcctcaggtatatttgtaagtgaactagatcctaaacgactcaactattcaaaagagtgataacattaaatgagtataaaatatttaaaaagacatatacatttaagaaaacatttaaaaatttactcaatattttactacaaatatactgactacattttaaacacactgttaattctattgttgcaaaacaaaacccttatctttaatacccaaaattgtttctattcctacagtaaaatgttccagtatttatatttactcaaatgccatgactaaagttctgtaacaaattttaactagtcctctttatttatttgaaaaaaatatttttttgagacagggtctcactctgtcaccccaggctggcatgcagtggcacaatcatagctcactgcagccccaaactcccaggctcaagtgatcctcccaccctgatcggccttccaagtagctgggactacaggcatgtgccaccaagcccagctaactttttgtatttttttttttgtggagaagtggtttggccatgttacccaggctggtctcgaactcctggactcaagtgatccacccgccttgggtctccccaagtgctgggattacaggcgtgagccagagcacctggcctagtctgcgttacttataaatttgttaaaataaaaatataataaattattaagctgatcttatgcaaacttaaaatgagatactcatgtcatttaaagaatttcctgaacacattttggaaaaaaatcaaagacacatttaataaattttttaatgcaagcaaattatttataggcaaatacctgatccaactgcctactgaaactcttgtaaatatcttgcttgttgacttcaaatataggtttccctttattaaatacagcatacataacagttcctaaagaatacatatcactggctgtttcacagctcacagaaagtatgtattcaggagccaaatattcaggatttggaagacacaatgaaggtaaatttgggtcccattctttacaaggaaatttaggctgtagtaagaaaaggaattacatgggttacttcaaattcaaccaaacaactatcaagcagtagtaatctatctttaaatttctactcggtcatgcaagtaaaaatgccatcacgccttcaatcccaaaattcccaaattcccaaatgtaaaaaagtccatgcaacaaaatgagaaataagaaccgttacaactgagattactggagtctcttccggaagacaaattatcactgtaatatgtaatatgaacatgtgaaggtctggctcatgttttatgatacacaggcttcaaaagttgtatgagctcagatagagactgttgtttgcaatttgttctttcactaattagctatgtgatttagttaaaaagttcaaaagattgtagtaacgattaaacaaatgtgtggaagtttgacctagcagtgtctgacccactcatgatatatatccaaccaatactagttagttctgattaccttaaaactggctgctcaacttacaaatcttaggtcaaatcacaggccctctaacgactacatataagaaaaacctatcaccaacgatcataaggtgccatatcaccaaggatcttctatgccatgcagacccaatcaatacaaggcagaattgatttaatacagtgtttctctaagtatgaataggcaggtatcctaatcattaagaaaaggtgctttggaagcagaaaggctgcgttcaaattctggctctatcacttaccatctacctaaatttaggcagttcttttattctctgagcctacttaacttatctgtattattcctataccccactgagttattgtgaggattaaataagtacagagaaagtgtgtggaaaagtgcttcaataagaatgttagctattgccactgctattattatgctccctaaagaatattccatgacccaataaacaggaaacactgctagagagtcacatgtgttattgcatttgacatcctgaggaaaaaaaaaaaccctatttaatcaaataattcttaaatttatttaactctggcatccttttctcaaataacattaactactgtggtagtaatgtgccgaagaatactcttaagtgcaatgaacactataaattttctataaagctgtatatctaaacataccactgtaccacatagcctatttctagtccattccagatgcaatcaaaatttccctggcctcaaaaattagaagactaaaactttcattacctcttgttcagaaggattggttgatgatacacaaaaatcaaaacccattattttccaggctccacttttattcaaa

SEQ ID NO: 13224 - DNA, 1065 bp, Homo sapiens
agtagctttacatgttcacgaacttcctcaggtatatttgtaagtgaactagatcctaaacgactcaactattcaaaagagtgataacattaaatgagtataaaatatttaaaaagacatatacatttaagaaaacatttaaaaatttactcaatattttactacaaatatactgactacattttaaacacactgttaattctattgttgcaaaacaaaacccttatctttaatacccaaaattgtttctattcctacagtaaaatgttccagtatttatatttactcaaatgccatgactaaagttctgtaacaaattttaactagtcctctttatttatttgaaaaaaatatttttttgagacagggtctcactctgtcaccccaggctggcatgcagtggcacaatcatagctcactgcagccccaaactcccaggctcaagtgatcctcccaccctgatcggccttccaagtagctgggactacaggcatgtgccaccaagcccagctaactttttgtatttttttttttgtggagaagtggtttggccatgttacccaggctggtctcgaactcctggactcaagtgatccacccgccttgggtctccccaagtgctgggattacaggcgtgagccagagcacctggcctagtctgcgttacttataaatttgttaaaataaaaatataataaattattaagctgatcttatgcaaacttaaaatgagatactcatgtcatttaaagaatttcctgaacacattttggaaaaaaatcaaagacacatttaataaattttttaatgcaagcaaattatttataggcaaatacctgatccaactgcctactgaaactcttgtaaatatcttgcttgttgacttcaaatataggtttccctttattaaatacagcatacataacagttcctaaagaatacatatcactggctgtttcacagctcacagaaagtatgtattcaggagccaaatattcaggatttggaagacacaatgaaggtaaatttgggtcccattctttacaaggaaatttaggctgtagt

SEQ ID NO: 13225 - DNA, 301 bp, Homo sapiens
tataatgaagaataagctctaataaccagtctttgaggagtttctaatcttcaggaagaatcagtcacataagaacacagctgtgacaaacagcgatagaggtatgcagagagacaattccataataatctttggacacattattcctttactcaaacatttaccacaccttgaaagttcaaatacctaaaccagacaggcatttaaagtctacctattctagtctcaatttatctttctcccattattctcctactgtattatatatatctgccaatcaaattgaattattccttcccag

SEQ ID NO: 13226 - DNA, 955 bp, Homo sapiens
tatagcattgcatttcttaagtaactacatacacacataaatatatcactatcaaaaaacatttctgtcacctgagggagtttcgaattttctatgtctcttcctagtctctttccccaaacctctactaaccatagttaattttgtctgaggattttatataagtgaaattatacagtaagtgtaaagtttttgagatctattcttgatgtactttatctgtaatttgttgcttttacttggacatatatatgtgtatatatggatgtctgtctatatatatatgtataagtaaaaactttagaaattttagaaagaaagcttttagaaatagagctactatgatcactctcgaaccaggtagtctttctttgttcatatgctttcttttctcttaagaaagtattaaggagtggaattgctgagtcatagcaaaaaaaatgtatgtttaacattttaagtagcttctaaatcatttttcaaagtgattgtgtcatttcacactcccctcatcagtatatgagagttttcacttaatttccagcatttaagattgtcagtctttcattttaatcatcttcttttgatgcttctttttgtctctgttctctaattaatgaaaaacattgggatcacatcaagagatataaaaaaaattatgcctttccaaggattaacctttgtgaaatttcagtgtgtcttgttttctcactataaatcaacaggtctgctgcacgagagtcagaacatcactacaaaatgaaaaacctgcaccaggagagaagcgagaaggcactgctaagggacactcgatttactcaagatggaataagtacaaagttacgtagtcaggagaactagtacgaaaaaggaatcaggtctgtgtcagagtaaaaattgcatctagcaaatttaaacaggcaaaaaagagttattcaaggccaatgcaatagaa

SEQ ID NO: 13227 - DNA, 6474 bp, Homo sapiens
ttttttatttatttatttatttatttttttaaattatactttaagttttagggtacatgtgcacattgtgcaggttagttacatatgtatacataagccatgctggtgcgctgcacccactaactcgtcatctagcattaggtatatctcccaatgctatccctcccccctccccccaccccaccacagtcaccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgccgcaataagcatacgtgtgcatgtgtctttatagcagcatcatttatagtcatttgggtatatacccagtaatgggatggctgggtcaaatggtatttctagttctagatccctgagaaatcaccacactgatttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatatccctcgcccactttttgatggggttgtttgtttttttcttgtaaatttgtttgagttcattgtagattctggatattagccctttgtcagatgagtaggttgcaaaaattttctcccactttgtaggttgcctgttcactctgatggtagtttcttttgctgtgcagaagctctttagtttaattagatcccatttgtcaattttggctttggttgccattgcttttggtgttttggacatgaagtccttgcccattcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagcaagttttcccagcaccatttattaaataggcaatcctttccccattgcttgtttttctcaggtttgtcaaagatcagatagttgtaggtatgcggtgttatttctgagggctctgttctgttccattgatctatatctctgttttggtaccagtaccatgctgttttggttactgtagccttgtagtatagtttgaagtcaggtagtgtgatgcctccagctttgtttttttggcttaggattgacttggcgatgcgggctcttttttggttccatatgaactttaaagtagttttttccaattctgtgaagaaagtcattggtagcttgatggggatagcattgaatctgtaaattaccttgggcagtatggccattttcacgatattgattcttcctgcccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggtatccctgtcttgtgccagttttcaaagggaatgcttccagtttttgcccattcagtctgatattggctgtgtgtttgtcatagatagctcttattattttgaaatacgtcccatcaatacctaatttattgagagttttcagcatgaagggttgttgaattttgtcaaaggctttttctgcatctattgagataatcatgtggtttttgtctttggctctgtttatatgctggattacatttattgatttgcgtatattgaaccagccttgcaccccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtcgattcagagattcaacttcttcctggtttagtcttgggacagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattgattttttgaagggttttttgtgtctctatttccttcagttctgctctgatgttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgcgagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttagggtagttagctcttcttgttgaattgatccctttaccattatgtaatggccttctttgtctcttttgatctttgttggtctaaagtctgttttatcagagactagaattgcaacccctgcctttttttgttttccatttgcttgctagatcttcctccattcttttattttgagcctaggtgtgtctctgcacgtgagatgggtttcctgaatacagcacactgatgggtcttgactctttatccaacttgccagtctgtgtcttttaattggagcatttagtccatttacatttaaagttaatactgttatgtgtgaatttgatcctgtcattatgatgttagctggtgattttgctcattagttgatgcagtttcttcctagtctcaatggtctttacattttggcatgattttgcagcggctggtaccggttgttcctttccatgtttagtacttccttcaggagctcttttagggcaggcctgttggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaggaggaagtcaaattgtccctgtttgcagacggcatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaaattgcttcaaagagaataaaatacctaggaatccaacttacaagggatgtgaaggatctcttcaagaaggactacaaaccactgctcagtgaactaaaagaggatacaaagaaatggaagaacattccatgctcatgggtaggaagaatcaataccgtgaaaatggccatactgcccaaggtaatttacagattcattgccatccccatcaagctaccaatgactttcttcacagaattggaaaaaactactttaaatttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagacatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggaatgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttggaatggcaatcattaaaaagtcagaaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaaggattataaatgatgctgctataaagacacatgcacacgtatgtttattgcggcattattcacaatagcaaagacttggaaccaacccaaatgtccaacaatgatagactggattaagaaaatgtggcacatgtacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtgccctaaaacttaaagtataataaaaaaaagtaagtaactaaataaataaata

SEQ ID NO: 13228 - DNA, 672 bp, Homo sapiens
aaaaatgttaacatatttcttaaaagttaagttagctgattcagcttcaaaaaaagttacttaattgaaataagttctttcaataggggaggtgctctgacatagcgatagtatggtttgataatacagtttttctcctctagctgcctcctgttcttgaggtaatgctcagtgattaactagataggactagataatttatttcaccttggcaggtcttgcctccaagttggcctattcctatggtatttccttttctttcttttgcttcttcctgcacactaagtatggtattttctgacagtatttttcttaattctttatttatttttcttggtaatttcttgctgtagagctggtacccattagacataatgactttccttgacttgcttcttgctcataaatttctgtaagacaatcaggaagtttttagaaacaaacagtggaaccaattaggctgttaagtgagacacgcctaaattaagctatgaggaaataaatacagctccagcaaaaatagaaataattttcagattatccatgcttttgtttccctggttttctttgaacctcatttcctcaagctatgaagtgaaatgaagtggtaagtacacctctaagtaggacattcagggtgaatccaaaggaacttgtgaatttgaccaaaaa

SEQ ID NO: 13229 - DNA, 267 bp, Homo sapiens
ctacagaaatggatcacacataacatacaaatgatgcaggcatgtagcaatcagttcttggtgtccaaactccttaagatctgatgaaacattttttgttctttccagaaaaaaagcgcaagcacacaagcttccaccaatgctctcatccttatttcacatgtgattctagggagtgtattttctccctgaagctcatttcatggactcccaattaaccacactctaggcctgcactgtccaacacagttcccactagcctcatgt

SEQ ID NO: 13230 - DNA, 321 bp, Homo sapiens
tgctctccctttggcagcttattaaggaatgtagtcgtttttcagcatttgccagctccctgtcgcagtcagtcaatagtacttattttaaagtgggattctcattgggattgcaagtaagaatcaatgtttttgttcctacccacacattttaatagacctcaaaaatagaatgcggggagaactgatagagaaacaaagaattttaggtacagaaagcacaaatagaataataatagaataacaagaataaaagaggaagtaatatactcttcgttctcaatgtagcatttatttgcacctcaccaaatgtagagcatt

SEQ ID NO: 13231 - DNA, 1398 bp, Homo sapiens
acggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgaggtaagcggttcttccggtggggtggggatgggagtaaaacaacacacgcacgcccggctcctttcactgagccgcggggcgcttctcccaatgtttccagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaattccaagcatgttcctttctggaattttttttttttttggtaaatattaacatagcaccaaattttgtaattaagtataaatgactatacatttgaatttagtttagggcaagattttatacaaggtcataagattaaatacagagtta

SEQ ID NO: 13232 - DNA, 16936 bp, Homo sapiens
acggtttctcccctgccctaggtccgaggctctttgccactggtccttgcaggcccggggaaagtgagccagacatttgcttctcctcgggtgtctcagctgctgacctgtccctctgccattctgtgtttgcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtgagtcctggggagctctgcaccccggggactgagaggagcatcctctcctgggagccgatggcactcggcctggtccctcccaacatgattctgataatggaagaccacgtcacccaaagcacttcagtcctggtctggcttctgcaggtctcaggctgtgcctcccatttctttcctcctcccactttttgtaagatgatcctggagaaaatgttgtatctgcaaataggaaatccacatgacaagtgcagatggccaatgggtggctttgaaaggtttccacctaaccaatcaaggcactgtaagtaaaacaaagagatgccatcatccacttctcacagtggtagtgattttttaaagaatggatccagggccagctggcaaggcctcggtaggatgaggatgctatgttttgggtgagaagtgtaacttgaacagccatcctgaaattttgtcacgagaaccttaaaactttgatcacttgttccatgtacacgaatctacatgaaggaagtatcaggtgaatgtaaggattgggaacgcccatcacctgtattcgtggcagcctgagtggttttctggaacaggtcagattgggtcactcccttactgtctgccacacacactgcagtctaagcggcttcccagggctccagcaccttcgtgatgggccctgggcacctctccaagctccccctgctcctcccctccacccaggccactccagcctctccctgttccacggccacctccttccactcacctcctgccctgtgacccattccactgtctggaaacttcccctgcctactccatactgcctctacgtatgtacccctgtgtacagcctcttatgaggcaggtttctgttgaaatgttacccgcaccactgccccccgcacccattctatccagagccttctcattctcccatccttctcagtccctgcactttatccctttattttcacagcacttcccaccacctaaagctacatgatcccccaggagcatgacagagaccctgagaccctggccttacaaccccatggccttatcatcccagggcctgcatcgtgcctgggagggactgctgcccagatccaaggccacctaaagctactggcctcacaaccccatggccttataaccccagggcctgcatcatgcttggcagggactgctgcccagatccaaggcttgcaaacctgtctctttaacattcagatgagctctgcctgagtctcctctgctctgtagagtaccagcaattaagagttaacttgctgagtagcagcaattaagaattaactctgggattctttgaaaacaggacaatgccatgtgcaaatctctttattctcctggatgaatgattaacgatagcaggagggaagacagcagagacattcttgccagaaatagatccacactcacccagccttccacagttccaagaaccaatcacatttcctaaaacaatattttctactatggactatattttagaaatggtactggcaagagttgcattttaatttattcctaatagccatttcaactacccctttatttttttgtaaaggccatgaatgaatatgcttttatcatgccttcaaaatcatcctcagagttttgagtcttaatctctctcatttgagcattttacctgttaccaatccagtggatggaaaatcattttatttttatttgtatcatttttttgagacaggggtctcactctgtcacccaggctggagtgcagtggcactatcaccactcactgcagccttgacctcccaggctcaatcagtcctccttcctcagcctcctgggtagctgggacttcaggcatgcaccactacaggcatgagccatggtccagctctggaaaatcattttagatatgaaatactgccacaaaatggcaattggttatgcaaaatgggcacagagattgataactcacagtgagaaatgctttctctcagtgctccctgactaccagctccaggaaacatttcctctttaaggaaaggtgtcctagagggaggtgactcaaacctaacattattcgtggtgcagataacacctgaaggaagagccttctctaacaggccaggaagaggctgagtggactgctggggtggccacaaaccatatattttccctagaattattaccaagtcagtgatgagtcattctcattgctgagagctatcttgttaagaatgtatttatatcagtcttgtgacatcaataaccacagaataccattaaaatatcaggagttatgttttaaaagaatattccttgacagaacaacattaagtaaagaaaatgaggctgtacatcaatataaagcaaggctcctattttgtttaggaaaagaagaccctccctgagtaacaccctgagaggaggctgcacacggcagcgttcgcagagcttctctttaggtggtagtgttagcaatggcttttgtttgtacgtcttggtatttttcagattttctgcaagaggcatgtattgtttttaggactttgaaagccccgcgccccttacctatttacctctgtttaaatcggaaggtccaggttctccagggaaaggagcccccctgtttcctgcagtgtttccagggggggatggtggtgcactcggggaggcgggaagaggaagaagaaaatgtgcaaagtaagtcacttttactgctggaattcgactttgcctttccctctcttggaaagaatttttataagctgggggctgaaagtgagtctgtcttcatctagctgtggctcgacctctgaaagcctcctgatgtttgcctgataactcagctctatgggtgctcatgacccgcctctccctggagaatttactcggggattcacctttgcacgcaggaggctggaaggtggtctcccctcctctgtctgctgtttttaggaagaaagaaaaatcagtggctcttctatgataaattatgaaattttgtgttgaccagcaccccaccccccaaaaaaatcttagctctagagccttttaaaatatgcctgttatagaacttgttgtataaatcttgggaaaatggcttttctacattgtggacttcagatcacctgcttctaactatgtaagaacccactttttaggctggcaggaaggcctgatgcctcagtgctccacagggctccctgtgcagtgcctcagcccctccagtcccctaagtccctggccctggacggaggtggctgccttggacgacacagcggacactaggaagggccgcgtttgctgccactcgctcacgtgctaactcctccgcgccgccggtgccccctgcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacagtgagtgttgtgtctgcggcgagtccccccacacaccgggcttcccagagggacggggcaggctcaggggtaccaagactcccagcagatcccagggtgctgaaagtgactgcagcaaaggatggctgggaacgtggtcaggggcctctgacattccgagcagagaggacacacatctcagtccagacctccgacttgggggccgctctgaggatttatctggctgggtgagaggctggtgaggagccagggagtgactcttggaagcactctgggttctttcttcatagttgccgttcagcttttggatgagaagcctgggggcctttgatatttaaagggagcacatttcaaatttgtggagttttcgtttgccagaacagcagagtgttaaaaagctaaagaagagtgtgggaaaccgccatctgtgtcagacgataagatatcccccattctggagagcagcccccgatggagagggatcggactctccgggcacttcccgggtacagcacttccgggttgggttttgttcccctcccaggcaggcacctgccgttggccacttgcaaagactcagcacactgtgagatagcactgagtggggaccttggggaagaggggaaccggaagggcagtgaaggccacagcccagggaggacgctgtggtggccggcccccccggtaaggtggtctgcctctgtggctctgcacttcctagcagcccaggcaaaataagcattgcaagctgccagagaagcccagtgtcgcccaggcattcaggaggcaactgagacctgtgaggacctcagtgaggaaaagtgaagagcttcctagggtcacatgtccccagagtttgatttggtgaaccccattctctgggttctggaacagagcagtggccagggcccctgtgtccactctgaaaacacactacccagagagggcagagaggagaacggggcaggtgacctctctacagggaggcagatgtgaaacaagatgtttcatctcaaaacaccacctgtgggctagggcacggggaggggtgagaaatcacatgccctgaggtggcccaaggcatttgaggcccatcagagggtttacttggaccactgaggaaaagaaaaacaatgaagagctcattcacatattcactcaacaaacatttattgagtacctgattggcgccaagcaatctggaattacaggacttatcctataaatctcggaaaaaatggtttttctgcatcatgaactttgggcaacctgcttctaactccaaaggactggagttaggaactggggacttggtggtgaataagcccaagtctctgtcctcatgaagttcatgttctagcaggagagaaagacaagaaatagtcaatatgtattgttctgtataaaaatgtgtgtaattttcatgacacattagatgtgattaaacatccctccctaggagcaagtcaacttcccctcctccaccacacacacttagagactgcagagcatttttccattcatgagtaagaattgcttttccttagaaagtagaagagacggtgaactgatctccagatttagttttgaataatttatggctgtaccccatatatatatgtacatgtatatatatatgtatatatatatacacctactattagtatatacccacaaattttaaatttaaaaaaagcagacaataacaagtattggcaaggatgtgaaaattggaacccttacacattacttggaaaacagtctagcaatttctcaaaagatttaacaatacagttaccatatgactagcaactctactagatatctacccaagagaaatgaaaacacttgtacatgaaggttcatagccatattagtcatagtggccaaaagatggaaataacccaaatatctaccaacatattaatggatgaaaaaaattagtggaatattattctgccataaaaaagaattcagtattgatacatgctacaacatggatgcaccttaaaaacattacactaagtttaaaaactcagtcacaaaggaacatatattatataattccatctgtatgaaatgtccaaaacaggcaagtccataaatacaggagtagattagtggattctgaggactaaggatgggggaaatgcggagtgactgctaacgggtacagggcttcttcttccgggagatgaaaatgttctgaaattagtgatgacagttgcacaactctgtgaataaactgaaatctgtacacataaaaagagtgaattttatgacatgtgaattatatctcaataaagctattataaagctgttatcataatagtaataataattttgggtcaccagcactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaaggtaatgtggcatccacagtctgcgatctggtttttttgtttgtttttggaaacaagagtcttgctctgttatccaggctggagtatagtggtatgatcacagctcactgcagcttcaacctcctgggctcaagtgatcagcctgcctcagcctctcaaagtgcaggcttgagccactgtgccccattcatgttttatcttaattcttcagtgtgtcttaaatctagtgtgatgagtattatgtccagctgattgaacagtttttttcttcccaggggtgagtttaacttggacaccaggacttcaaattctcactggcaaatcagctcccaaggcctcccggggaccaagccaccttccagggtcttagggactcagggcaccattttctttctttcctcatagctgccacctgagaaatagcagtcctctgggtgttggagtgcgatctggggaaggaagccggcctcttatcccctttccagagcccttcagtcattaacctatttggaaatacaaagatcgtgtctgtatagaacaggcactcccattcaccagagtgaggttaggtgtgtatatgtgtactttcccagctgttctaaaaatacagatgaacattagaaggaaagcgaacttttgttaagcagttccagtaagccagacaccagccagcaccttacatatagtaactccgttagtacaacccaacactctgccatttttacagatgaggaaactgaggcatacagaagttaatcaacttgcccaaggctgggcagcaatggagtatcctcataactgctccataatactctgcccctcaatgtttataaacttttatatagctttttaaacataatgcctagaaaacgtttgaaattatggagaagttaaaaaaagaaatgaagtcacttataaccacatttctcagaacagaattcacatttctctatgctatatataatatctattttaaaaaataatatgtggatctactgttttgtaaccttttttcctttataatgaataatttcccaagttattaaaatttagatttctaatggctgtgagatattctgttatactgtgaatatatgccactctctacctgacagtctctgacagctggggagttgagttgtttcttatttctgatttttctcccttatacaataatgcagtttgaatactttttaaaataatcctatacattcattcctaattgagaggaattcctagatgtggaaccgctgtgcttgtcataaaatctgatagcatgtatcagctcgggccaagtttcattctcacctgcaatacacagaagcgttcatttctcagcacaatcataaattcagcatattattttttcctctttgccaaattgatgaaaggagacagatagctaagcattgttttgttttacttagaagtacatatagatgtatatttatatacatgtataatgtatataaaatacaatatatgtatatttatgttatataacatatatgcatatttatgttacatatgtgtatgtgatatacacatacatatatctgtgtatagatatgcatatatacacagtatctatatatattttttagccattttaatttctactttggtgagtgttctatttgtgtcttttgcacattttattgatatttattttttccttatgtatgtcccttcatgtattaaggatattaactagttgctgtattacaaatatttcccatttgttacttggtttttcttttctttttaattttgcattgtttttcatttttatataattaatgcattattttcccttttgattggttcttttactattgcacttgaaaaggctttctccaccttgaagctcagataaatcctacctgtgtttccacagtgctttgaattatttcatattttacattcattcttcatctggaatttactttgatgcacatgatatcttcagctttgttctcttttctttcaaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccaggtaaggcctgcagggggcagctatgctgagcagtagaaggcacatcttccagaaagccttttgattttacgttggtatttattaagcagcttctgtttgccaagtacattcccagagcacccagaacatgtgcttacactcttttcatcctcacccctacaccaaaaggaaggagagtgaaatcagccacactttatagcataaggaacgagactcaagtcacttaacccacccaaagacgtcagctaagaacaggttgagcaccacagcggcaggcctggcgtctccgctcttttcccagccttcctctcagtcttgttgctgcatggtcacccgtcgactgccattgctccagccattatgtttgcattcaagatagaaagagaaagaaaggggaaggaaaaaagcccacctaatagccactctctctctttaatcagataaagcacgtgttttcccagaagcccccagcagacttctgcttacatcccattggccggagcctgtcacatggccagccccagctgcaagggagcctggggaagcaaatggcagaggagaaggatgttggggtattggctaagttagccagggaacagggtctgccataccaagtctccacagcagagccaagactccagcccaggtcttctgatcccaaggtcagggctctgtgccctcattctggttgggaaagtaacaagagactgggcttgacaacccctcccacccaccctccaatgaagccaaggtcagctgcctctcagtttgtgtttgttgcttctcacattacaagagcctggagctgcagccagggacctcatcttgcaccgggatctcagggcagcactgaaagtttgcccagtgcacatgtcatgcttggaaaatcagccaccagtaagagagggtgtgcccacgcccttcatcctggggctcagggcgggttatcaacctccactgggcttttaaagtgtggttttcacagaatcctgaaatgcatgtcaggaaaggacttacagtgagccgactagcaagagtgagaggcattttgccacctggagtaagagtcagactgacaatttgaggaggagaaaaaggtaggaggaaaaggcagtagaacagttttgatttttatttccttttattttattttttagagacagggtcttactctgtcatccaggctggagtgcagtggcgcagtcatggctcactgcagcctctaactcttgggctcaagcgatcctctctccttagcttcctgagtagtggagactacatgcatgcagcaccatgcctcgctaattttttttttctttttgtagagatagggtctcatcatgtggcccaggctggtcttcaacctccgggctcaagcagtccttcctcctcagcctcccaaagcactgggattacaggcatgagccaccactcccggtggcagttttgctttttaaggcccatttctctgtaagagagccatgagctcacctcactgctaagcaatcgcgtgcagggcaggaacgccactgacctgtctgcagtgagatgtgcgctccagtgttgattgtgctctttggagatatgcggtgctaacagccccttgagtggcacatgcattatcccttccactcttagcacagccctgccagtatccagaagggccagggccttgagctggggcaaagggaggaggacctggaggacgaggaatgaaaaagaccaactccttgacaccacttctctctgcctacaggcttctccccgttgaactgtcaaagggctggggtatcctgggtttctctgtttgcccctttgcccctggtttgatggccaagggggtttccccctgtgacactgcagtcaagagggacaacatccactaggttgggggaggagtgagctagaagtgtccgtgaaggagctcctgatggtctggccctgtccctgccctcacagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggtgaggctccctctaacatgcctgcagcacggaacagatggggaagcccctcaggcatgcgcagccaggagacccccttccccttctgtgcatgtcagccagcatccatccataaagcctggcaggtggtgatgaaaccaattttttcccctttaactttttgagatgtattaagttttagattagcgcattctcagctgccagcatgaagaagaactagtttttctctctgatattatgaggctaacttgttaccctcaaggataaaggctgtattgtggaatgccccaggcagattaaaaccccgctgtactcggggttgatcatgctgagagacaagttggcctctgccctgtacattatctgcaagcactaccacgctgttggagaatggaggtctcccccaaacagtgaacggccattgccaacctttttattattcattattatttttagtattatatccaaagagaaatacccatagtaagttcatggttctttactatacacatgaaatttctagtcttttatataaaatgaaaatgccagtaattaatcttatttaatttttatggtttcattgacacaactagtttaatgtcactgagtatgtgcaatggattctcttcctgaaaaactctttagcaataaataacatatgaaaccttccactcaatgttatagtgaatgtggatgtataagatgctgtcgttcgccgtcagtcattatgggagttaatcctgtgctaggaaatgagacggatgactctacaggtgaattcaggaggaagaaaatgctccacccagaagctgcagacagagcctctctctcccttccaggaatacacagcgttttgttaggttcaagaagtatagactcaggttgattataggtcactatggtagtcacaggcatgaaactaacaaacatcttatataaacattatccatgtgttgttatgaactactggtaacttgcattttaagcatgaagtcatgagttctggcaaagaagaaaagatttcaagggaaatcagagaaagacagggtctccctggggtctactgacattgcaatctgtgtaactacaggaaaaaatctcaagaaaccagcccccaagtcttaccttatccacgctggtctggagcccctgacattcaccaatatgtttcccagctgggagcacagagaggacatcgctgagatcacagagatggtgagcacgctttcctgccctatgaaggtggctcctgcgccttttggattgtgggttaactttactttggggagagcatccaattgcactttcagagtgggaaaatatttttccttttgcaacatcttaacaaacctacatagaatttgcttaggaagaagagaagtctaatggaaaatcaattaactattttagtaattttctacacgatacccaaattttaaaaacttaaaagcaaaggtgagttgaatcatgttgaggactatatatgtacataaaagctgcgaactcttcattctgtttgctaagaacctgttgcttggcattgcttgtctctcagtgtccatgtgacgcacaaccaaaccctcatgtttcagatgttaaccttgtgtagaggagacacaaacgaaatctgatgaattagtatgttcagaaaactgaatgaatggaggtgctgcgactcccttatgataagggatcactcaacatctcattaatattgtcttttatgagaccacctggtatttctgcatgaggcatttatcataacttctatccaccaaaatatattataatctagaatgttttcttttccaaccacacaggaaagaattttattatagctatgttgaatttcttatatatgagctattaacattgctaggaatagcaaatccaaggatttgttttgatttggtgagagataggttttttaccattttgatttttttttaccatgtgagagctgctttgcttggggaaacgacccaagtgtattttataggaaattcgagtaattttaaacaaacagaatctacttctgcttagcaatggagagggcctgttgggtagtacagacatcactgctcaccctaacctgtctccctggagccaaatggacttgatgtacacagggaaggggctgacttcagcttggtgtctgccgcagccggaacgagatgtttctgttcactgcaactgtggtttcgtgaaaccagaaggctctagggattacgagctctatggctgctgcatgcagtctaagttcaggagttaccaaattgccaggggttcagtccagggcttattgctcactacacagaagaaagccaatcactgagacaagcatagccaaggaagaaagtttatttgggtgctacagccaaggggaacaggacataagtctcaaatctgtgtctctggcctactaaaattagggatttttatagcagggaagaaatgtaaccatgtgtgggaaacaggaattagggaggggtgaggaagaggagctggtcaacaggaagcggggggttggttaggcatcatggtgggtaaggggtctggtaagcttcaggttttgtttttgttttttgagacagggtcttgctctgttgcccaggctggagtgcagtggtgtaatcacagctcactgcagcctccagctccaggctcagacaatcctcccacatcagcctcccaggtagctgggactacaagcacacaccataatgcctggctaatttgttttgtattttcaatgaggttttgccatgtctctcagtctggtcttgaactcctgagctcaagccatctgcccacctcagcctctcaaagtgctgggattacaagcatgagccactgctggctttttgatactattggagatgcctgatggttggtttcctgagaaaggaactcagataagacaaatataactttctcgaatttcaagactaggagagttaatttcgacgtttattccaaagaaatcataaacatcagttctgtggcacagttgagccactttcagaaggatataactcaccatcctccctgtgtattcactatagatcttgggggttagcagcggggccatttactgttgtgcaggcctgtgggattccagccggagaagagtcaggcttcccacaccagcaagttatacaaataattaacattcagcaagtgcccactctgcactaggcacatctccaagcactttacactgattttctcatttatcacaacagtccatcaagatatcttattattattcccattttactggtgtgggagcagagacacaaaaacacgaagtcacttggccaaagtgactttcagtgagtggaggagtcagtactcagacgcaggcaagatcatccaaaattcgcctcttctttttttagagaaaggatcttgctttgtcacccaggctgcagtgtggtgactcaatcatggctcacacaaaccttgaacccctgggctcaaacgaccctaccacctcagccaccccaagtaggtaggactacaggtgcacacttccatgcctagcctatttttgtattctttatagagacagggtctcatcatattgcccaagctggtctccaactcctggattcaaggactcttcccacctcagcctcctacagtgttgagattacaggcacaagtcactgcacccagcccaaaacctgcctcttgaccaccagtctgttccatgtatttctaatatgagcaacagctcttagtcatgcattcccaccatccacccacccaaaaggagagcagccaatctggggtcccaagtttaatggaggaagagaatttacccagaatagtttgttcatattcacacagtggttttaaaaacaaaaaaattgattctgctccagaatattctaggtgcattttctgaccttctttttctattgcagattaagaaatggggccaggggagggaaggggggtgtgatttcttttcaggttattttttaatatttatttttaaacaaattccattatttggaggcttctggtgtttagacttcaaatctactaatcttagtccataattcactcatgggacagtccctaaacatttttccagagacagttctgagacagggtttgtttaaaactctgtgacaaggtgagaaaagatctataagtcagagaaacaagactccatcatctctacaaaaaaattttttaaattattaggtgcgcgtggtggcacatgccaatagtgccagctactcaggaggcttgaggtgggaggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctaagcagtatagcaagacccagtctctacaaaaaaaaaaaaaaaaatggaaaaggaaaaataaattagccaggcctggtgatgcatactcatagtcccagttactcaggaggctgaggcaggaggatcacttgagcccaggagctggaggctgcagtgagctatgattgcaccactgcactccagcctgagtagcagagtgagaccttgtctcaaaaaataccattttttaatttaaaatttaaaaattttaaaaattaaaagtccagacaactgcagggctttgggcgatcccttttctttcagagccatttcctcctcagtgatatggaactatgcatcctcaggcagtatgcaggtggcacagggctgtgtgtctgtaagcacttaataaaacaagttcaaatgtaggacacgagctctcctctctgccccctcctcttctctaggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgaggtaagcggttcttccggtggggtggggatgggagtaaaacaacacacgcacgcccggctcctttcactgagccgcggggcgcttctcccaatgtttccagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaattccaagcatgttcctttctggaattttttttttttttggtaaatattaacatagcaccaaattttgtaattaagtataaatgactatacatttgaatttagtttagggcaagattttatacaaggtcataagattaaatacagagtta

SEQ ID NO: 13233 - DNA, 398 bp, Homo sapiens
tccctaaacatttttccagagacagttctgagacagggtttgtttaaaactctgtgacaaggtgagaaaagatctataagtcagagaaacaagactccatcatctctacaaaaaaattttttaaattattaggtgcgcgtggtggcacatgccaatagtgccagctactcaggaggcttgaggtgggaggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctaagcagtatagcaagacccagtctctaca

SEQ ID NO: 13234 - DNA, 3334 bp, Homo sapiens
agaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacacag

SEQ ID NO: 13235 - DNA, 6081 bp, Homo sapiens
agtgttggtgttcactcactatatgtctttaagaaaattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagtgtctgtatgtgtgtatagatggatggatgtaactcatactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacattttcctatttccagagttacatatggtcttttggcattacccaagtgagcctccctttctctgatatgccttgtagccaaagtattaaaggctgatgaacatagacaagggaaatgcatttcttagaaatccgtgaacctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacacag

SEQ ID NO: 13236 - DNA, 305 bp, Homo sapiens
ccagtttttttaagcaattttattcccatgaagataaactctattgagtgactattggataattactgaaccttaggcagtgtgctgaatgttggggttacaaaaatgggattaccactcagatggtaagagtgtaccatctgataaaagacataaaccctcgtccgggtgcggtggctcgcacctgtaatcccagcactttgggaggccaagtttggtggatcacctgaggtcaggagttcgagaccaacatggcgaaaccctgtctctactaaaaatgcaaaaattagctgggtgtggtggcg

SEQ ID NO: 13237 - DNA, 740 bp, Homo sapiens
tataaattgtgttggaggtgggtaggaagctgtgagtatgacttgaagaaaaatatccttttcagtgacaaatcagagtttcttacaagttattgtcctgctcccttccaagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagttgccatgaatcctcacctgtaggagtttctgggattcattttaaggaaactggaagaaaattaatgttttaatgtaaatgtttttaaaaccaagatcaccatagagttcacacaaaattttaggcagtgtttcaagaagcactcttatgtgttgttctttcagcccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacgagagagctttagaatttaataaaatgtcaaaaatacaatttgatacccttaaaaattattcatagatctggctgctctgtactactggatgggtggaataggga

SEQ ID NO: 13238 - DNA, 305 bp, Homo sapiens; identical to SEQ ID NO: 13236

SEQ ID NO: 13239 - DNA, 739 bp, Homo sapiens
gcggagggtgcagtgagctgagatcgcaccactgcactccagcctggcggcagggcaagactctgtctcaaaaaaaaaaagaaaaagaaaagtgtgctctttcatttccaagtatttaaaatactcctgttatcatgttgttatttttagtttcacatttggcctgagcacaagctcgtttaatttcaaaacatttatatttgttgaagtttgttttggggccataaacaaaaagcccataaacaacatgcttgtggagtattccgtaggtacttgtaaaaaggatgtatattctggtgttgtttggtaaaatattctgtgtttatggatcctgttgattaatgatgttattcagactttctatattttcctcattttttgtctaatattttgctaaaagaaggatgttaaagtccccaacagtaattgtggaattttttatttcttctttcagttctatcactttttgcttcatatatttgaatgttctcttgtttggtgtatatgcatttatgattattatatcttcttcatgtattgtccctcttatcattatgaaactttcctctttgtccatgttcattttctgagctctgaagtatactttgtcttacactaatacaaggtataattgctgcatttttaaaagttaatgtttgcatggcttatctttgtccatttcttttattttcaacctgcctacatcattatatttgaagtaaattttatgtagacaaca

SEQ ID NO: 13240 - DNA, 1067 bp, Homo sapiens
ttggtccagggtcacagagctgtcaaggcaccttgcacttctaggccaggacacagaaaggggagttggggaccactacaatgagcaatgttggtcagtagttttatttgtttgttttcactttatctgattttggtgtttgactaatactggcctcccaaaatcaactgggaatttttcctccagtgccaccccctttttatttgcatgacattttgtagaattggtgttgtttctttaagtattcggtagaattttttggtgaaaccatttaagtctggaggtttctcttgtggaaggtttgaattacgtagtcattcaacttaataggtactcaaactatttcatattgggtgggttttgatagattattatttttgaggaattgttccatttcatctaagttttgtaacttaaatttgtggagttatttatttgaagtattcccttattattcccttcatgacagaaggttctatagttgtatcctttgttttattcctaatagtggttatgtgtgtcttctttatctttgttaatcttcttagatgtttataaattttattgactatttcaaagaaccagctttctgtgtcattgattttctatgtgttctgactttgatttctattctgatcattattattttctttttctacttgttttggttgtatattgctgtttgtagattcttgaggtgggagcttagattatcattagagactttattctaacataagcatttagttttataagctaaactcagcactgtttgagctccatcttacattttcctatattgtaattatattttcattcagcttaactatttctcgattccatttaagaaattatctgtgacacatgggttatttagaagtgtgctcttttggccgagcacggtggctcacgcctgtaaccccagcactttgggaggctgaggcgggcagatcatgaggtcaagagatggagaccatcctggccaacatggtgaaaccccatctctactaaaaatacaaaaattagctggcgtggtggcgggctcctgtaatcccaggtactcggaa

SEQ ID NO: 13241 - DNA, 9477 bp, Homo sapiens
gatggccctgctgtggcaccagtgaccaacgggaacacaacggtgccacccctgaacgatgatctggacatctttggaccgatgatttctaatcccttacctgcaactgtcatgcccccagctcaggtatgtgataagaatatggttttatatggtcactgcttatttcctttttgaaaagtttcaaaatttcaattttggaagaattgtttctgagcagtaactgatttaaaagtctcctgttctttaggctagagtttagcaaactaagccagcagcttgtttttgcaaataaagttttattggcacacagccactcccactggtttaggtactgtatgtggctgctttcctgctacaaaagcagagttaaatattaaaaacagagaatgtatagcccacaaaacctaaaatattcactgtctttaaagttctaacccttgctttagggaaacaacagtatttagaatgaacaagtggaaaaaccctgactacctcaactttcctgagatcaacaaggtcacttacttcagagcttttaaaactgtggctgtttgtaaatattgactgcagaagttctagcaaatttagtactgtctttttaaaataaaggcaaaatgaaggtaaattatgttttaagttagccttaaaatctaccttgcttttttttttaagtgattttttaaaaatctagaacagtaataataatgatcgggatattttaataaaagtattaatggtgaagaaattttgaattgccttcttaacattacatggaatttttgtaatgtgaactgtatgaactttcaggaaacaaactactcttaagcatacaacattaagattctatcttaagtttatactttacaaataaacaagcagtttgtgcagcataatttttgagataaaatatttccttttccatagaaaaactgagtcaaatctgaattgttctggtagacagttttaataagaaaaagtcaatgtcttataaggctaggaacatatttctgttgcacatatttattgttattatgatagtcattatatagttaccattagaatggaacaagtagatttcttaggaatgattaaatggatctttatcaaaattgtctgcagcagtagtgtttattttcagcaaaatagcttattttatggctttgccccttcttcccctcctgtaacacacataaaaaagagaatattgttactgttatttcaattaagattaattaccttacaaattggtacaggcataggtgtacatgtgacaaaattgtctaatattgtgtctttggaaagaagcatttaggatatttgacaaccagaatgtgaaaagccatttatttttagtctagcattgtagtgcggctgttatacctgctagacttatttagcactgtcactggggtctgacagttgctttgcaactgcttaagagagttagatcccacctctgaggtttcagtgtacttcacgtgttctgttctgtattaaagcagcaagtagaacaatgcagacttcgtttaattcttaagcacaagtagtgccatgacaaggagtgtagcctctggctttaagaggggtggcagctggccttcagactttaggcattctgagcattacctggtaggacatagggttaatttttaaaatcatatctaatacttcttttggaacactgttatgttgagcactggttagactgtacaagttatgttgagccctgtaaaatatttggtgaacagtagtatctttcgtctaaacttcatgtagagattaaaatccagacatatttggccaggtatggtggttcatgcctgtaatcccagcactttgggaggctgaggtgggtggatcacctgaggccaggagttcaacaccagcctggccaacatggtgaaaccccatctctccttaaaatacaaaaattagctgggcgtggtggcgtgcgcctgtaatcccagttactcgggaggctgaggcaggagaattgcttgaacccgggaggcagaggttgcagtgagcggagatcacgccattgcactccagcctgggggacaagagtgagacttcgtctggaaaaaaaaaaaaatccagacatattttcaaaataatgcctttgaaaatgggggatggtgctgaaactacagattctatgcatatattgctaccatgtaatttagtcattttggtgggtttttaatatgtgaagttgagctcaaactagttgtggacaccaagattttgaattcttctgaaccctgtattctttcactccttgtgttattttctgagtatatacaaattctagtacaatattttctaacttatgaatatgaaatagattgattttaccatctgccttacctgtctggggtctagtctttcttaaaggggttagttagaaatacttagctgacaggagtgtacctgtgttttgggggctggagaggaacagttccagagtcttcattgttgacatggagaaacccctttcctgttctttcatatacatatacatatacatatacatatacatatacatatacatatacatatacatataccaacagtacctagacatacacaagggctaagtcctgttttttcttggttaagcccttgggtcccagaaggccagagagccttcgattagatgctctgcagcttcctgaagtgtaaaatgagaggcagaagttgtttcccttttatcctggggtcgtagtgctggcgagtggagcaccagaaagtaagtggacatttgagtgcttactagtcctgctgattggtttggctgtttttagactgtgtccttgttgaggtagatatttcatattatgatgtttacagtatgtgaatattaggctgctctactatgagagtggaatcatagcttcccaacattttgggttttcttatagttgtctcttatccacagggaatagaccccagggttttcagcagacttttaggttgaacagatactaagtgtgataaaaagatcacttagtgatgtagttgctttgttttataaacaatattaacaataaacaccaagtacttaatccaaccattgtgcagaacacttttgtgatcattaagcttatcccaagtttataggagagagactgaaaggagaagtaaagtaacatgtctgagtgtaccacagaaagtcatgggggcaggctctagtcctggcagacaggctccagcccatgctcttagctctatgatctgctgctgcttcattggtagcttagatatattttattcaggggtattgtgatatttagtattccatgatatctaatttcttacatatttgaatttttggaaaattaagcggctttttgtcgcttacaattcttgcttagtcataagattcaaaatactgtgtagtttataagtacaatgtttggatggtaacttattgcatggtgttctaggaggacattaaatgtttgaatttaatttccacttgcaactcaccttattctgtagtttgagaaggatcagccagcttttactagtcttcatagaattctttgaaactctcttcatattcaaaacaagtccatataacatgtgaatgtgatttaatgtttagtgactacggagatgattaaggttagcagttgtgattgtataatagtgtgtgcaagatatgagattgagaatattttatattaaatatctacatgtttatttgtatttgtgttcatttgcccccttgtccaaaagtgaagggcaggatatgttcagacaatagatggtcaaagttttgctgtaccttcatttctggatagattagaagcagtctaatattgtagttaaaactgattagatgtataaaaatcctatgatacaggttttgaaaagataaaaccttttaagtagccattgcaaatcctcttacagtctgttgtagttgtagaaatgttctttattccaaaggataccagtttcttgaagcagtagttgctatggagtggtggtcctctcatctctaactattgttgagccccaggatttgatgagcaaaaacttggtgtcaccttaggtagtaaatgcaacttactgtgaaaatgcttcagtctacctacattaacagattcaaattaagaagtactgtcttgattgtagatgtttttatatgggcttgggcttgtaagtgatcctcttgaatggcaccattttaccttctacaattgtttgattcctatctaattttataactttatttggattttaagtaatggataagctgcgctttactatgcagaatttgatagcttattttggtgtttgtctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttcctttaaaataatgagctgcatttcacatgtgagctaaaattgttgggcagcccactacacctattgaagcgagatatagtcagctctcacttccctgtttcgtactgggggaccagtggtacaaatcagcaataaaacagtgtatgatgtcatgctacatagtttggtcttcacagtggaagatattttgtgtggctgttgcatatgatttacatttcttaattaaatttactcaggttaataactgatttgtctgcatcctagaaacaaccagctctcagggtttaggtgtgggttggtctgagtagtaggagcagccaaactggaattaaaatgtttgctgtgagtagttcagaaaggcaatttttctgtgattatagagatgagtgcaactacacgtgatagctctgtcttcattcattttctttttgtggtgcaggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacaggtaggggtcatttactttctagcttctcccaaatcaaaccagatttattttctaaatcttttttttttttttttttttttttttttaagtctagtgatctggcagaaagaattcaatagggataatatgttatagggtcaaaagtatctataaatattatgaagttgtatcagatagacaaatgatgtgttattatcgctattttagagtattctgtaaaaaaaaggttaaacatctttcatttcaaattgtaatgtaactgtaacgtgaacaccactaatggccagaaattatctcaggcatcatgagactccctctctgtcacctctgagattagcactaagctttatccagcttgctggtgggacatttttacagtccacttagacaacttagcttcactaataattttaggatcttttattagaaaataaaaatctagcctcatattctcaaagcactattttatgagggatctaaggctatttttcaggtcggatgattactgccccatggctctgtaaaaattctttttgttgagaaacctttgtaaagttgtattttctttttacataccctataatgacttttatgtttaaaaagagtacaaaaagattcaattcccataaggtgtgaaccagacatcccctcatattataaaatcctatttctacctaagttagagctgagatagaacatttctatttcaggtgctgtgttctgacttttctctagctgcacagacaaaggctcttagagaggttcatgctcccactcttcttccttttacacttcccattgatgttcctccagcattttggcaatcttggtttctgtttggtcacttgttttacctttagagcattcagggaatagtctagagtgatttctaacattagcacaatcactatatatcacagttaattttgctaccaccatttacaagaatataggtaaaacattggtctctacccgctgggaatctaaaaaattgtatgtgctaagtgtcagtcacatggtcaacatgctgaagcacacccagctcaggttaaggtgctagatgaaccaggaaggagttaatactggctcttacttccagataatgcagaagggtgatgctgttctccagcactccatcagtgcaatctactggccaatgacaaggtggttaaaatgtcctttagtaggtatgaagacgtgatctgcttcttcagacacttatgcctgattagtgatgtagtttatgttagtgtctttgaaactgtaaataagtcaagtcaaatgtattaaattaagaacacagtctaactctgagtgtaagttttaaacccactcactatatggtaaatcttgcctttccttctcttatcaccaattttggaagtaagagaatcacagggttaagatgcttatatatatatatatttgactccagtcttgaagaaaaatacatgtaatcttatgctttattgcatacaatgaaaataaattttagatgtttatgttgttagatcagcgagagaaataaatgctttatgaccactttaaaaatatttaggaagtatataagattttaatagagaataatatctatcatacaaagtttataggataattttagactattttacttcctaaaattttcttactccttagtagttaaagcacaatatcctagtgtaggtgaaagttagttagagtagcggactcattaaaatcccaagattgctttggtatttttttttaagtaagttgtggttaatctttggggaaactgtatctagaaagtagataaagaagggaacaaagtagctatttgctttaagaaatatttgtatggtactctgtttttattccagtgcttggactagttgtcacattaatgaaaaaatgaccaactgtgtggctaaagaaacaagaattaaaagtgaagtaagcctcttgaactaagccttttatatgtttcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaagagactttaaaa

SEQ ID NO: 13242 - DNA, 9496 bp, Homo sapiens
gatggccctgctgtggcaccagtgaccaacgggaacacaacggtgccacccctgaacgatgatctggacatctttggaccgatgatttctaatcccttacctgcaactgtcatgcccccagctcaggtatgtgataagaatatggttttatatggtcactgcttatttcctttttgaaaagtttcaaaatttcaattttggaagaattgtttctgagcagtaactgatttaaaagtctcctgttctttaggctagagtttagcaaactaagccagcagcttgtttttgcaaataaagttttattggcacacagccactcccactggtttaggtactgtatgtggctgctttcctgctacaaaagcagagttaaatattaaaaacagagaatgtatagcccacaaaacctaaaatattcactgtctttaaagttctaacccttgctttagggaaacaacagtatttagaatgaacaagtggaaaaaccctgactacctcaactttcctgagatcaacaaggtcacttacttcagagcttttaaaactgtggctgtttgtaaatattgactgcagaagttctagcaaatttagtactgtctttttaaaataaaggcaaaatgaaggtaaattatgttttaagttagccttaaaatctaccttgcttttttttttaagtgattttttaaaaatctagaacagtaataataatgatcgggatattttaataaaagtattaatggtgaagaaattttgaattgccttcttaacattacatggaatttttgtaatgtgaactgtatgaactttcaggaaacaaactactcttaagcatacaacattaagattctatcttaagtttatactttacaaataaacaagcagtttgtgcagcataatttttgagataaaatatttccttttccatagaaaaactgagtcaaatctgaattgttctggtagacagttttaataagaaaaagtcaatgtcttataaggctaggaacatatttctgttgcacatatttattgttattatgatagtcattatatagttaccattagaatggaacaagtagatttcttaggaatgattaaatggatctttatcaaaattgtctgcagcagtagtgtttattttcagcaaaatagcttattttatggctttgccccttcttcccctcctgtaacacacataaaaaagagaatattgttactgttatttcaattaagattaattaccttacaaattggtacaggcataggtgtacatgtgacaaaattgtctaatattgtgtctttggaaagaagcatttaggatatttgacaaccagaatgtgaaaagccatttatttttagtctagcattgtagtgcggctgttatacctgctagacttatttagcactgtcactggggtctgacagttgctttgcaactgcttaagagagttagatcccacctctgaggtttcagtgtacttcacgtgttctgttctgtattaaagcagcaagtagaacaatgcagacttcgtttaattcttaagcacaagtagtgccatgacaaggagtgtagcctctggctttaagaggggtggcagctggccttcagactttaggcattctgagcattacctggtaggacatagggttaatttttaaaatcatatctaatacttcttttggaacactgttatgttgagcactggttagactgtacaagttatgttgagccctgtaaaatatttggtgaacagtagtatctttcgtctaaacttcatgtagagattaaaatccagacatatttggccaggtatggtggttcatgcctgtaatcccagcactttgggaggctgaggtgggtggatcacctgaggccaggagttcaacaccagcctggccaacatggtgaaaccccatctctccttaaaatacaaaaattagctgggcgtggtggcgtgcgcctgtaatcccagttactcgggaggctgaggcaggagaattgcttgaacccgggaggcagaggttgcagtgagcggagatcacgccattgcactccagcctgggggacaagagtgagacttcgtctggaaaaaaaaaaaaatccagacatattttcaaaataatgcctttgaaaatgggggatggtgctgaaactacagattctatgcatatattgctaccatgtaatttagtcattttggtgggtttttaatatgtgaagttgagctcaaactagttgtggacaccaagattttgaattcttctgaaccctgtattctttcactccttgtgttattttctgagtatatacaaattctagtacaatattttctaacttatgaatatgaaatagattgattttaccatctgccttacctgtctggggtctagtctttcttaaaggggttagttagaaatacttagctgacaggagtgtacctgtgttttgggggctggagaggaacagttccagagtcttcattgttgacatggagaaacccctttcctgttctttcatatacatatacatatacatatacatatacatatacatatacatatacatatacatatacatatacatatacatataccaacagtacctagacatacacaagggctaagtcctgttttttcttggttaagcccttgggtcccagaaggccagagagccttcgattagatgctctgcagcttcctgaagtgtaaaatgagaggcagaagttgtttcccttttatcctggggtcgtagtgctggcgagtggagcaccagaaagtaagtggacatttgagtgcttactagtcctgctgattggtttggctgtttttagactgtgtccttgttgaggtagatatttcatattatgatgtttacagtatgtgaatattaggctgctctactatgagagtggaatcatagcttcccaacattttgggttttcttatagttgtctcttatccacagggaatagaccccagggttttcagcagacttttaggttgaacagatactaagtgtgataaaaagatcacttagtgatgtagttgctttgttttataaacaatattaacaataaacaccaagtacttaatccaaccattgtgcagaacacttttgtgatcattaagcttatcccaagtttataggagagagactgaaaggagaagtaaagtaacatgtctgagtgtaccacagaaagtcatgggggcaggctctagtcctggcagacaggctccagcccatgctcttagctctatgatctgctgctgcttcattggtagcttagatatattttattcaggggtattgtgatatttagtattccatgatatctaatttcttacatatttgaatttttggaaaattaagcggctttttgtcgcttacaattcttgcttagtcataagattcaaaatactgtgtagtttataagtacaatgtttggatggtaacttattgcatggtgttctaggaggacattaaatgtttgaatttaatttccacttgcaactcaccttattctgtagtttgagaaggatcagccagcttttactagtcttcatagaattctttgaaactctcttcatattcaaaacaagtccatataacatgtgaatgtgatttaatgtttagtgactacggagatgattaaggttagcagttgtgattgtataatagtgtgtgcaagatatgagattgagaatattttatattaaatatctacatgtttatttgtatttgtgttcatttgcccccttgtccaaaagtgaagggcaggatatgttcagacaatagatggtcaaagttttgctgtaccttcatttctggatagattagaagcagtctaatattgtagttaaaactgattagatgtataaaaatcctatgatacaggttttgaaaagataaaaccttttaagtagccattgcaaatcctcttacagtctgttgtagttgtagaaatgttctttattccaaaggataccagtttcttgaagcagtagttgctatggagtggtggtcctctcatctctaactattgttgagccccaggatttgatgagcaaaaacttggtgtcaccttaggtagtaaatgcaacttactgtgaaaatgcttcagtctacctacattaacagattcaaattaagaagtactgtcttgattgtagatgtttttatatgggcttgggcttgtaagtgatcctcttgaatggcaccattttaccttctacaattgtttgattcctatctaattttataactttatttggattttaagtaatggataagctgcgctttactatgcagaatttgatagcttattttggtgtttgtctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttcctttaaaataatgagctgcatttcacatgtgagctaaaattgttgggcagcccactacacctattgaagcgagatatagtcagctctcacttccctgtttcgtactgggggaccagtggtacaaatcagcaataaaacagtgtatgatgtcatgctacatagtttggtcttcacagtggaagatattttgtgtggctgttgcatatgatttacatttcttaattaaatttactcaggttaataactgatttgtctgcatcctagaaacaaccagctctcagggtttaggtgtgggttggtctgagtagtaggagcagccaaactggaattaaaatgtttgctgtgagtagttcagaaaggcaatttttctgtgattatagagatgagtgcaactacacgtgatagctctgtcttcattcattttctttttgtggtgcaggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacaggtaggggtcatttactttctagcttctcccaaatcaaaccagatttattttctaaatctttttttttttttttttttttttttttttaagtctagtgatctggcagaaagaattcaatagggataatatgttatagggtcaaaagtatctataaatattatgaagttgtatcagatagacaaatgatgtgttattatccctattttagagtattctgtaaaaaaaaggttaaacatctttcatttcaaattgtaatgtaactgtaacgtgaacaccactaatggccagaaattatctcaggcatcatgagactccctctctgtcacctctgagattagcactaagctttatccagcttgctggtgggacatttttacagtccacttagacaacttagcttcactaataattttaggatcttttattagaaaataaaaatctagcctcatattctcaaagcactattttatgagggatctaaggctatttttcaggtcggatgattactgccccatggctctgtaaaaattctttttgttgagaaacctttgtaaagttgtattttctttttacataccctataatgacttttatgtttaaaaagagtacaaaaagattcaattcccataaggtgtgaaccagacatcccctcatattataaaatcctatttctacctaagttagagctgagatagaacatttctatttcaggtgctgtgttctgacttttctctagctgcacagacaaaggctcttagagaggttcatgctcccactcttcttccttttacacttcccattgatgttcctccagcattttggcaatcttggtttctgtttggtcacttgttttacctttagagcattcagggaatagtctagagtgatttctaacattagcacaatcactatatatcacagttaattttgctaccaccatttacaagaatataggtaaaacattggtctctacccgctgggaatctaaaaaattgtatgtgctaagtgtcagtcacatggtcaacatgctgaagcacacccagctcaggttaaggtgctagatgaaccaggaaggagttaatactggctcttacttccagataatgcagaagggtgatgctgttctccagcactccatcagtgcaatctactggccaacgacaaggtggttaaaatgtcctttagtaggtatgaagacgtgatctgcttcttcagacacttatgcctgattagtgatgtagtttatgttagtgtctttgaaactgtaaataagtcaagtcaaatgtattaaattaagaacacagtctaactctgagtgtaagttttaaacccactcactatatggtaaatcttgcctttccttctcttatcaccaattttggaagtaagagaatcacagggttaagatgcttatatatatatatatttgactccagtcttgaagaaaaatacatgtaatcttatgctttattgcatacaatgaaaataaattttagatgtttatgttgttagatcagcgagagaaataaatgctttatgaccactttaaaaatatttaggaagtatataagattttaatagagaataatatctatcatacaaagtttataggataattttagactattttacttcctaaaattttcttactccttagtagttaaagcacaatatcctagtgtaggtgaaagttagttagagtagcggactcattaaaatcccaagattgctttggtatttttttttaagtaagttgtggttaatctttggggaaactgtatctagaaagtagataaagaagggaacaaagtagctatttgctttaagaaatatttgtatggtactctgtttttattccagtgcttggactagttgtcacattaatgaaaaaatgaccaactgtgtggctaaagaaacaagaattaaaagtgaagtaagcctcttgaactaagccttttatatgtttcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaagagactttaaaa

SEQ ID NO: 13243 - DNA, 8925 bp, Homo sapiens
aggcctccctggaggtggacggtttcagtccacacatactgggaccccagggagacactcaccagcatccgagcctgccatgtttcagaggcaggtcgccgccggactccgacgcggccgggaaggcgacggtgtcctggaaggaccgatccacgcagacccgacactggggcgcggacgcacgaaccaaagcgcggggaaggaggcgtgaaagaaggacggacgttaaaagagcttctcgccgctgattggtcatcagaggagcacttcctttcacaggacgtgaaacgggggcggtttgggaagtttagagaccattctccgccgaccaaaacccctcaaaggattatcagacacgcgggtcggacggtccacatcagccggcagcccgggcgggtcccggggtgcgagcagcgcacttccggtgagctatttcgttttgtatccctccgccgacgtcaacgggaaagtagtgcggaccgctctctcggtggtccggggtggtacagccacgtgacaacgccaggccccgccttccccctcttttggttacagacgtgagggctctttggagacgtaaacatctccgagtggcgagggtgggcggggctgggcttgggaaagggcggggtggcttgcttgaggtgtggaaagaccagaagaaggtgaggtcaagagagtgcagaatgaggcattccaatggtgggtgggccctgacctgagagagtggcgcggggaggggtgaaagcgcggcgatcctggaacgccagcgggcgttgcggcctatgcgcgaggggcggggcgattaggtcatagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtgagtttgggagccgagctgtcaggcctggcgggtggggggatgggagggcgggtcagggtggcggccggcgggggctttgcggcttggacttggcctttccgggctatcttgggacttcctttcccgaaggcttgcgccattttgatattcacgtcacagtgattggaagagatttgacggtgtagtgtcttcaagcttgctttttgtgtggggattggggagctgtcggggcggctgccatttggtagctgttgagggagttgagagggagcgtattgtgcggatgaaagcgggacgcttcgaggcagacgaaggaacatctgttaggtgcggcgtttcgggaggtgtttttggggtggccgggcattctgtgggagcgaggggaccacttccaaagccctggtgctgttggggtaggagggcggccggcatcagccatgtggctgagtcgcgagtacaaaatgccggcctcggacatggcggcggcgcctttgttaccccgcccggcggaggagctcaaaatggcagcgtcgagaaaatgtggcgcagagagaaatgcgagacaaagggggaagcgccgccccagcgggaacgccgcccggccgactccgcccgggccgggactcctcccccggtagtcgccggctcctccttttcttttttcctgcgttatataattttgattcgttgatccggagctctaccgcggcgttcccccagctgggtttgctagcagaagtgtttctgagaaaacccttgttctgttatcgctgactgtactgtttaggttcttaccactaaagctgtttggttccaaaacggccatatgagtaacatcgtcgtgatgctcttcggttcatgtagccttgttattgctgatagtgaattgctaggctggtggggaagattacagtaaccacaagaagtggtgtgtgccagaatcccaaattctggcatgtgggtgacaagtttccgacatgataaatccccggcttccgacatgataaatcccaggctgtttacatgacctaagtaatgtgtacttgggactacgggaaatgttaactgtggctgttgagagagagagagattttcacgaaggacagtgctaggtttacctctcgaagtctgttttcagtggtttttagcttgtgccaatggatgacaaatctatacagaaacctgggtatagccatttgaaaatgtgaataacgttttttttcattccaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcagtgagtaaattcatgtggcttcatcaggctgtaactcgatcgtggattctagtaaatgaaattctgacaggtgttttgcaaataactcaattttggtagagttacatgttctgacttcataattgggaaaggtgtgactcacttttggatataggtggctttgggatttttacttaaattaggttgagtataacaataaattttttttttcataatagggtgttcataggtgggtccagattaaaatgaaggctactttaaactagttactaaattatgaagttaggggcttatcaattacgtatttagctaggggtggttgtcatgaattttaagactgttataatttgttttgcagcaagaggtggaaacatacagaagaagcaaggaaattacagttagaggtcacaactgcccgaagccagttctaaatttttatgaagccaatttccctggtaagtgctacttttcagttctacctacccgtgtttttgtttccacctaccccctctttttcttggcatcactaatttttactaaatatctgttactaattatagcaaatgtcatggatgttattgcaagacagaatttcactgaacccactgctattcaagctcagggatggccagttgctctaagtggattggatatggttggagtggcacagactggatctgggaaaacattgtctgtaagtttgggagaactcttgagttgatctgatatatgcaagaaaatgtaatggtaatttaaaaacgagtattttaatgtgatttctgtttgtccccactttcaccctaaatagtatttgcttcctgccattgtccacatcaatcatcagccattcctagagagaggcgatgggcctattgtaagtatatatttttaactttttattagaagcataatgtgtagattttagactacatagctaaagatgtaatcatttgtggtggttttatatagaggttagctcaccctattcagctggagctgttttgggtattggacaacacatgaagaaaggatctgctagtataataagttagcagtttaaaactagtatccaggtttgtgctgaaagctgtttctctttccttagtgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtatgtaatgaaaagggttttatttgtcattggtgctaaatatcctaggtattgtagttacacttacgtatttaattaaaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagagtaagtgtcctttgaaatatgtgatcaaactgaattgtgttttcactcttaagagtctgatactaatttttccccccaaaatccattagcctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcagttggtgtgatttcatttagttagcctactaatcctgaaaatttcttgaatccttcaaataatggctgtcaccatttatagctttcctatagaaggaattcatgtgtcccctggttgacttaaggaccaagggtcgaactgctcgataagtggattagcaggcgtttcctctttgacttccagccatgtaaattgaacttaatgttttgctgaccataaatgtgtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtagaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcacataaaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccctcacctacacagtagtcgtcatgtcgagacctgccagagagagacacattctcaagtgaatcctggcttcttggaagcgcttgcctagacgagacacagtgcataaaaacaacttttgggggacaggtatgttttcttgcagctgcggttgtaaggtcttggcaagacaagcagtgtggccagaattttgaacttctgatgaatgtgtaatgcaaaggaccttgtacatttttttgtttcaaggtcctcaaaatgagcacatgaagaggttgctgtgaaactttaagtggccctactgcgcagaagcattcagatgtcacttgatgatctgtaagggaacttgctgatttgggaatgtgcttagggaacacacattccttttgacagggtctgtcactgggtgggtgatgaattatacagatgacatgtgcttttttttcttttttcaacctcaatggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattgttttcttgacaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctcccca

SEQ ID NO: 13244 - DNA, 622 bp, Homo sapiens
tggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggta

SEQ ID NO: 13245 - DNA, 7873 bp, Homo sapiens
tcccggtcgagatgttggtgattggggacgacagcgccttcactgtcctgaagaagccacgccggcgggtgctgtgcggcaccgtgcttatacacaaggtgggcttccaccggggaccgtggagactggccagccctttccagccttcccttgcctggcagcacccagtaactggacctttccagcccttccccaagaagctagttctttttctccagtgttccctgatctcagaaggccccgccatcccctcagctacctaagcccagatacaggcattttcccagactcgtccccttttcttctccacacccaatcagttgcccggtcctggtgcttctcctcccaaatgtacaacacacatccttctcagaccccgccctcctgctttgccttggttcaggggtcatctactcatgcctgatggctgcagccacctcctcactgggctcccctgcctgcttcctgccttctggccttgctcatccattctccacactactgccagaggtgtctttttaaaatgtgtatctgactaggttattcatccactgaaagccttcttgggtgcctacaatcaatacaagccctcaccatagctccctgactccccaccttcatctcccatcatccctgccttcctcttttttttattttcttttatttattttttatttatttctttattttttgaggcagagtctcactctgttgcccaggctggaatgcagtggcgcgatcttggctcactgcagtctccgctgcccaggtttaagtgattctccttcctcagcctcccgagtagctgggattacaaggcgcctgccaccacgcccggctaatttttgtatttttagtagagatgtggtttcaccatgttggccaggctggcctcgaactcctgacctcaagtgatctgcccgcctcggcctcccaaagtgctgggatgacgagcgtgagccaccgcgcccagccatccctgccttcctcttatggtctattcacgccagctcctgtacctgccaggctatggatcatctctggctttgcttatgcagtatctgtggcctggaaaattctttccttgtccagcctccttttggcctggctaactcctaccattctacagaggcccagctctgatgtctccccacctggaaggctctccctgatctccatctccccactaccctgagctggttggcagccagtcctagtgtggactccatcactgtaattaccacctcacataaattttcaatttatgggtatctgcttccctagcctctccccaggctgtgagttcttgaaggtggagactgtgacttagtcgccttttttccttttcagcatatactagatgcttggtaaaaattgggtggatggatggatggatagatgggtaaagtgacccaaaatagcaaggctatgggagagagaactctggaactctagagttgggaaactggccacccactggctgtgtgacattggacaagtcaccgcccctctctgggtccatttccccatttgtaaagtctcttctgactccaacagactggaattcttgaagattcctggcaggtacactgtgaatgaggggagtttgctcttctgccctaaatgtgatgggccaggttgagtgtgaaaatcctgaggttcccccttcccaacaagaaattcatcccctgcctgtcttctaccccacatggtacagtgataccctcccccctggggcttttacctctttgtggctgcaggtggcaggtgctctggctgaggctggtgtggggctggaggagatcgcaaagcaggtgaacgtggtcaccaaggccatgggtgagtgctggcctgggagctggggaagagagtggggaaggttggacagccctggggcgaggagcaggttcctgttggctgcctagcggtgctccccaggttattccccaggggtctagggagtgtatccctgggggagctcctggggactggtggccttgggtaccatggctgaggtggagagtctggcagcctttctcagagaagagggtacctgtgggcagggcctctgagatgctgctgccacccttcctgatgcccagtgctaagagtggaacagtcatcccttcatgccttgtttctcataggtaccctgggggtgagcttatcctcctgcagcgtccctggttccaaacccaccttcgagctctcagccgacgaggtggagctgggcctgggtaagcttgtggccatccatcccagccctgcctgctccttggccctggactttgcccaccttgcatacccttagagccatcaacctggtcctctccccaggtggtcttagtatttttacctggtcatttgaggcccagcctgggccaacctgcctgatttctacctgctttgctgtctatacccacagctttggccatgtggagctctgtgcactgcccacctcctagcctttgcctgccattcccaggtcctcctgtccctgccagaatacacccttctttcaacggctattcaaagatcacctggctgcaaagctttctttcctcgcctgtgcttcctccttaactatctctagttaaagctatctccaccaccaggccacaagctcccagagaacagagatcgtgtttttcattattctgtccatttccatcccccactcccgcccacttactgtgtgagtccagcactgtgtgagtccttgataaaaacgatgagcaaatccccaggccttgagtgggtcagcagtgaccacatctatccgcagggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggtgggtagcctctcgcccgcgtctcccaacccctcctacacctctggggaggagacgcccagagggtctcacctggggtgtcatgtctacccgcaggctcctcagttgtgatgatggtcaacaacctgggtggcctgtcattcctggaactgggcatcatagccgacgctaccgtccgctccctgggtgagccatgcactgggaaggggatcctacagccctttggaaagggctgagggagggtcttgtgatggcagagaacacggactgtgcgtcagataagcctgagttaaatcgtctctctgccacctaattgccggataccttgagcctctgtttgttttcttgtctgcaaattgggggtaataataatggtacctgctttataccgttgttttgaggattaagtgagattaaacatatgtaagacactcaacacagcgcccagcacctggcacgaactgagtaaatgagacctgtaattactcatcttccccgacgtaggggacacctccagggaacgtggtcatttgtggggttattgagggatgcctgccaggaggaaatcaggacatctccctcccgacctcagagccccagcttccaaggtccttgcttttctgttgttttctttccctgatgcccatttttcccttttggactgccacactctggtattgcagagggccgcggggtgaagattgcccgtgccctggtgggcaccttcatgtcagcactggagatgcctggcatttctctcaccctcctgctggtggatgagcctctcctgaaactgataggtgagacttggaacctggggtcacccaagccagggctccttgtaactggaaggagccagggagacttggagaccccgtcagggctgaccgtgacaatcagggctctggagcctgtgaagaaggctcttcctgggcttctccagccttctccagctctcactggactagaaggagttggtattaggatcctcctcagagaggcctgaccctttcccagggaccctctctccatacccctgtatacagtaggcactcagtccatgcttgtcgaggtggactcccttcctccagggctgctgagaaagccaggccaccagggtcaggatgggagggtccaagccctgctgaatccctggctggacagccgtgtctaagagagttatcttgctgcccttagatgctgaaaccactgcagcagcctggcctaacgtggctgcagtctccattactgggcggaagcggagccgggtagcccctgccgagccccaggaggcccctgattccactgctgcaggaggtaccaacccctgcctttggggaagggacaggcttcccaaaggatgcaggagtatacggtggggcgggtaggggccctggcacccacacctcccaccatagtcaagtgtggttgtgagaagggcctggtgggcctgttcttcagcatcctccctttctaggctcagcctcgaagcggatggcgctggtgctggaacgggtgtgcagcactctcctgggcctggaggaacacctgaatgccctggaccgggctgctggtgacggcgactgtggcaccacccacagccgtgcggccagaggttggtgccagggactttgccaagtgaggtcattcacaaaaccttagccccccttccacttgtttccctgaaggcagggaccttcctttttttttttttttttttaagaaggaatctcactctgtcgctaggctggagtatgcaatggtgtgatctcggctcactgcagtctccgccccccgggttcaagtgattttcctgcctcagcctcctgactagctgagataacaggcatgcgccaccacgcctggctaattgttgtgtttttagtggagacggggtctcgccatgttggccaggctggtctctaactccccacctcaagccatccgctcgccttggcctcccaaagtgctgagattacaggcatgagccaccacacccggccgacagggaccttcttaacaccacaaatgtatgaggttgttatcttagaattaaatgaaatccttcacagtgaataacttacaactcaaggcgaacttattctgttgtccttatttttctcagtttacccagaccagtgaaaagctcttaactgtccagcatcattcattcgagaaaaaggtatttggtgcctgccgtggggcaggcactgctctcagctgtggatacagtagtgaacagagcagacagaaatcactgccctcatggcttatgttctaggtggaagacagtcaaccagataaatcagtaaaacacagaggatgttagcacaaagggctaaggagaaaaaaaccaagccagggagcagagtacagagcgtcaagtggagggcttcggggcaggcctcacctccccaggcccctttcggttacgcagcccagcccctctccagactgcacactggatgtggaaagggatcttgggaagccttcattccacttccctgtcggccttttccagccttcattggtgctggctggaagtctggcagatggagggaggatctctgaattcctccccatctctctctgcctgcagcaatccaggagtggctgaaggagggcccaccccctgccagccctgcccagctgctctccaagttgtctgttctgctcctggagaagatgggaggctcatctggggcggtgggtgcctgggggctgaagggctgacagggaggtggctgggctggctggggtccaggccagcaccacatgctcagcgttgtcatcttccccagctctatggcctgttcctgactgcggctgcacagcccctgaaggccaagaccagcctcccagcctggtctgctgccatggatgccggcctggaagccatgcagaagtgagccagagccctgtgcatcagaccaggggtgggctgggggaggtgtttggtgacatctgcgccctgccaggccctagcccaaccctcagagtgattcccttggttccctatagtgagcctctttcactctctttccctgccaggtatggcaaggctgctccaggggacaggactatggtttgtactcaggctgtggcctcagacctttctccttttggccctgtaagtctaaagagcaccctcggttgcagggcccgtgctcagccccctttccttcaccttgtccagctggattctctgtgggcagcggggcaggagctccaagcctggaagagcccaggagctgatctgttacaagtcctgaccaaagcagtcaaggtgagtgaggctgggcccagccacctggggagacaggcttctagccagcagactcctgtctccatgtgaccctgagcaagttaataaccttcctggaccgcagtttccttctctgtacaatggagatgagcacctatctcagaaggtggttatgtggctaaggaaatatatagagccccgcacactgcctgggatgtgacagggcctcagtgaatggtgacccttttccctgctggaagtagatgagaagtgactttccatttggtgacagagcagagggtgctggcagagccagggcaagggcgtgcagggccaggctgcacggcagagacgttctgcccatggcaggaaggaggcggcctggtgatctgcccttgaacctgctcccacaccccatcccccagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgaacccctaaggcagtgtctcctcacctgggctgcttccacctcagcccccgacccatcccctttccagtacacacacctgatgcatgtgagaatggtagaggggcttttctcagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaaaaaaaa

SEQ ID NO: 13246 - DNA, 8091 bp, Homo sapiens
ggcctggcccgggagcaggcccgggctgaaggcatcccggtggagatggtggtgattggggacgacagcgccttcactgtcctgaagaaggcaggccggcgggggctgtgcggcacggtgcttatacacaaggtgggcttccaccggggacgtggagactggccagccctttccagccttcccttgcctggcagcacccagtaactggacctttccagcccttccccaagaagctagttctttttctccagtgttccctgatctcagaaggccccgccatcccctcagctacctaagcccagatacaggcattttcccagactcgtccccttttcttctccacacccaatcagttgcccggtcctggtgcttctcctcccaaatgtacaacacacatccttctcagaccccgccctcctgctttgccttggttcaggggtcatctactcatgcctgatggctgcagccacctcctcactgggctcccctgcctgcttcctgccttctggccttgctcatccattctccacactactgccagaggtgtctttttaaaatgtgtatctgactaggttattcatccactgaaagccttcttgggtgcctacaatcaatacaagccctcaccatagctccctgactccccaccttcatctcccatcatccctgccttcctcttttttttattttcttttatttattttttatttatttatttattttttgaggcagagtctcactctgttgcccaggctggaatgcagtggcgcgatcttggctcactgcagtctccgctgcccaggtttaagtgattctccttcctcagcctcccgagtagctgggattacaaggcgcctgccaccacgcccggctaatttttgtatttttagtagagatgtggtttcaccatgttggccaggctggcctcgaactcctgacctcaagtgatctgcccgcctcggcctcccaaagtgctgggatgacgagcgtgagcccccgcgcccagccatccctgccttcctctttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctgccttcctcttatggtctcttcacgccagctcctgtacctgccaggctatggatcatctctggctttgcttatgcagtatctgtggcctggaaaattctttccttgtccagcctccttttggcctggctaactcctaccattctacagaggcccagctctgatgtctccccacctggaaggctctccctgatctccatctccccactaccctgagctggttggcagccagtcctagtgtggactccatcactgtaattaccacctcacataaattttcaatttatgggtatctgcttccctagcctctccccaggctgtgagttcttgaaggtggagactgtgacttagtcgccttttttccttttcagcatatactagatgcttggtaaaaattgggtggatggatggatggatagatgggtaaagtgacccaaaatagcaaggctatgggagagagaactctggaactctagagttgggaaactggccacccactggctgtgtgacattggacaagtcaccgcccctctctgggtccatttccccatttgtaaagtctcttctgactccaacagactggaattcttgaagattcctggcaggtacactgtgaatgaggggagtttgctcttctgccctaaatgtgatgggccaggttgagtgtgaaaatcctgaggttcccccttcccaacaagaaattcatcccctgcctgtcttctaccccacatggtacagtgataccctcccccctggggcttttacctctttgtggctgcaggtggcaggtgctctggctgaggctggtgtggggctggaggagatcgcaaagcaggtgaacgtggtcgccaaggccatgggtgagtgctggcctgggagctggggaagagagtggggaaggttggacagccctggggcgaggagcaggttcctgttggctgcctagcggtgctccccaggttattccccaggggtctagggagtgtatccctgggggagctcctggggactggtggccttgggtaccatggctgaggtggagagtctggcagcctttctcagagaagagggtacctgtgggcagggcctctgagatgctgctgccacccttcctgatgcccagtgctaagagtggaacagtcatcccttcatgccttgtttctcataggtaccctgggggtgagcttatcctcctgcagcgtccctggttccaaacccaccttcgagctctcagccgacgaggtggagctgggcctgggtaagcttgtggccatccatcccagccctgcctgctccttggccctggactttgcccaccttgcatacccttagagccatcaacctggtcctctccccaggtggtcttagtatttttacctggtcatttgaggcccagcctggccaacctgcctgatttctacctgctttgctgtctatacccacagctttggccatgtggagctctgtgcactgcccacctcctagcctttgcctgccattcccaggtcctcctgtccctgccagaatacacccttctttcaacggctgttcaaagatcacctggctgcaaagctttctttcctcgcctgtgcttcctccttaactatctctagttaaagctatctccaccaccaggccacaagctcccagagaacagagatcgtgtttttcattattctgtccatttccatcccccactcccgcccacttactgtgtgagtccagcactgtgtgagtccttgataaaaacgatgagcaaatccccaggccttgagtgggtcagcagtgaccacatctatccgcagggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggtgggtagcctctcgcccgcgtctcccaacccctcctaaacctctggggaggagacgcccagagggtctcacctggggtgtcatgtctacccgcaggctcctcagttgtgatgatggtcaacaacctgggtggcctgtcattcctggaactgggcatcatagccgacgctaccgtccgctccctgggtgagccatgcactgggaaggggatcctacagccctttggaaagggctgagggagggtcttgtgatggcagagaacacggactgtgcgtcagataagcctgagttaaatcgtctctctgccacctaattgccggataccttgagcctctgtttgttttcttgtctgcaaattgggggtaataataatggtacctgctttataccgttgttttgaggattaagtgagattaaacatatgtaagacactcaacacagcgcccagcacctggcacgaactgagtaaatgagacctgtaattactcatcttccccgacgtaggggacacctccagggaacgtggtcatttgtggggttattgagggatgcctgccaggaggaaatcaggacatctccctcccgacctcagagccccagcttccaaggtccttgcttttctgttgttttctttccctgatgcccatttttcccttttggactgccacactctggtattgcagagggccgcggggtgaagattgctcgtgccctggtgggcaccttcatgtcagcactggagatgcctggcatttctctcaccctcctgctggtggatgagcctctcctgaaactgataggtgagacttggaacctggggtcacccaagccagggctccttgtaactggaaggagccagggagacttggagaccccgtcagggctgaccgtgacaatcagggctctggagcctgtgaagaaggctcttcctgggcttctccagccttctccagctctcactggactagaaggagttggtattaggatcctcctcagagaggcctgaccctttcccagggaccctctctccatacccctgtatacagtaggcactcagtccatgcttgtcgaggtggactcccttcctccagggctgctgagaaagccaggccaccagggtcaggatgggagggtccaagccctgctgaatccctggctggacagccgtgtctaagagagttatcttgctgcccttagatgctgaaaccactgcagcagcctggcctaacgtggctgcagtctccattactgggcggaagcggagccgggtagcccctgccgagccccaggaggcccctgattccactgctgcaggaggtaccaacccctgcctttggggaagggacaggcttcccaaaggatgcaggagtatacggtggggcgggtaggggccctggcacccacacctcccaccatagtcaagtgtggttgtgagaagggcctggtgggcctgttcttcagcatcctccctttctaggctcagcctcgaagcggatggcgctggtgctggaacgggtgtgcagcactctcctgggcctggaggaacacctgaatgccctggaccgggctgctggtgacggcgactgtggcaccacccacagccgtgcggccagaggttggtgccagggactttgccaagtgaggtcattcacaaaaccttagccccccttccacttgtttccctgaaggcagggaccttcctttttttttttttttttttttaagaaggaatctcactctgtcgctaggctggagtatgcaatggtgtgatctcggctcactgcagtctccgccccccgggttcaagtgattttcctgcctcagcctcctgactagctgagataacaggcatgcgccaccacgcctggctaattgttgtgtttttagtggagacggggtctcgccatgttggccaggctggtctctaactccccacctcaagccatccgctcgccctggcctcccaaagtgctgagattacaggcatgagccaccacacccggccgacagggaccttcttaacaccacaaatgtatgaggttgttatcttagaattaaatgaaatccttcacagtgaataacttacaactcaaggcgaacttattctgttgtccttatttttctcagtttacccagaccagtgaaaagctcttaactgtccagcatcattcattcgagaaaaaggtatttgtgtggccgtggggcaggcactgctctcagctgtggatacagtagtgaacagagcagacagaaatcactgccctcatggcttatgttctaggtggaagacagtcaaccagataaatcagtaaaacacagaggatgttagcacaaagggctaaggagaaaaaaaccaagccagggagcagagtacagagcgtcaagtggagggcttcggggcaggcctcacctccccaggcccctttcggttacgcagcccagcccctctccagactgcacactggatgtggaaagggatcttgggaagccttcattccacttccctgtcggccttttccagccttcattggtgctggctggaagtctggcagatggagggaggatctctgaattcctccccatctctctctgcctgcagcaatccaggagtggctgaaggagggcccaccccctgccagccctgcccagctgctctccaagttgtctgtcctgctcctggagaagatgggaggctcatctggggcggtgggtgcctgggggctgaagggctgacagggaggtggctgggctggctggggtccaggccagcaccacatgctcagcgttgtcatcttccccagctctatggcctgttcctgactgcggctgcacagcccctgaaggccaagaccagcctcccagcctggtctgctgccatggatgccggcctggaagccatgcagaagtgagccagagccctgtgcatcagaccaggggtgggctgggggaggtgtttggtgacatctgcgccctgccaggccctagcccaaccctcagagtgattcccttggttccctatagtgagcctctttcactctctttccctgccaggtatggcaaggctgctccaggggacaggactatggtatgtactcaggctgtggctcagacctttctccttttggccctgtaagtctaaagagcaccctcggttgcagggcccgtgctcagccccctttccttcaccttgtccagctggattctctgtgggcagcggggcaggagctccaagcctggaagagcccaggagctgatctgttacaagtcctgaccaaagcagtcaaggtgagtgaggctgggccagcaccctggggagacaggcttctagcagtcagactcctgtctccatgtgaccctgagcaagttaataaccttcctggaccgcagtttccttctctgtacaatggagatgagcacctatctcagaaggtggttatgtggctaaggaaatatgtagagccccgcacactgcctgggatgtgacagggcctcagtgaatggtgacccttttccctgctggaagtagatgagaagtgactttccatttggtgacagagcagagggtgctggcagagccagggcaagggcgtgcagggccaggctgcacggcagagacgttctgcccatggcaggaaggaggcggcctggtgatctgcccttgaacctgctcccacaccccatcccccagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctgccccattggcccaccctctaagttgagcaggaaatcctccaccaagcttccagaactacagacagcacccagagtgagctggagtgggtcccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttcttagcattgaattaataattcagtggctcctcgggagtcgaatgggcatttgggacaccagaaggaaaagaaatcatcatagtctaaggttcagttgtagatcaaaaaatgcactcaggccgggcacggtggctcacacctgcaatcccagcactttgggaggccaggcaggcggatccttacactcaggagttcaagaccagtctgggcaacatgtgacaaccctgtctctaccacaaaatactcaattacgcaggca

SEQ ID NO: 13247 - DNA, 3254 bp, Homo sapiens
ggcttctctacccagggtcctgtctgtcggctgcaccatacgtccctgaccacaaggcatccacgtgcacaggagtatgcgcccagcagctgggaaggaggctgacctcagacggtggcctgtggatcccagctctgtcatttcctggctgggtgacctcaacctagtcaccctttttgagtcttgttttctcagattatgaaataggaaaaatttccttcctcgtgagataagcacgtgccattagctattaaggacacgcacataaatgagctgcatgtgaatccacacatgccattccatgaagacatcaaagagggatcatgtggatctttggtgccttccggttggcccctccctaggtctgtgagggtcagacctgtcctgaggcttttacaaattggcccagaactcatttaaccacagcatcatttcattagagggctgttattagagactgaatgtttgtgtcccccccaaattcctgtgttgaaaggctcacccccactatggtagtgtcaggacgtggggcctttgggaggtgatggggttatgagggtggagccccagagagtcctcacgccctttccaccatgcgaggttatggtgagaagatggtccctgaggaagctggcccttgccacaccccacctctgccagcgccttcatcttggatgtctacagcctccagaactgtgagaaataaacacttgttgttttagccacccaggctattatatttttgttatagcagcctgaacaaagacagctttgattcttaacatatttaatgaaactcgagcttcataaaccagtgaaatgcctacccctatggagacggggagctggtcatgggacccaggtgcctggaggacatcccagtggctttgaaggctccagccagtcaagacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgctaggttgggccaggcaagcagccatggtggggccaggtgaagcaatgtgggtctcagcaaggaacccctctgaaggtggcagtggctcccagggctgctgcacactggacaccacaactttggcatcagctgcatggtgagctgcagagtggtcagaggggctggggccctgccaagagagcaaggccagacctgcccagcgggaggcaggaaggccctgatccagcaaggagaagtagaggaagtccacagccacctctgttactcatcgctactgggacatctggggacaggctctgttcttgggagagcaggtcaccaggatttgtagggctgcctgccggtgacagacacgtaagtcacagggaaaggccgggatcccaggcctcagctgtagcagcagctggaagaggtggagccgcacggtcacaatacatgcagacacagagcagcaatacgaaacagaacagctcagagcggtcagctcctcagcagaagctgcgtgggccgccactccccctttctgcaatcaccccatgatgtctccaccccacctcacatccagatggggctggatggcagagcagatgaagcctgctctgtggcggggcagcctaactgaaatgcacacctttatgggggaagtggacggacacctcacctccctcatgtttcacaccgtggactgcacttgagtcccagctcttcaccacatccctaggagtcttaagaggaaatcagtctgatttcttcagacaggagcagcaagagcggccagagcgaggaggacctcgtgtgaatggaggacctgagaggctgacgccaaggagtgcagaagccaaagccaccaaggaaagcagacaggcagcaagcagccagagaaggcaggcccagcacccaggcaaagccaccaaggaaagcagacaggcagcaagcggccggagagggcaggcccagcacccaggcaaagccaccaaggaaagcagacaggcagcaagcggccggagagggcaggccagcacccaggcaagaagtctgggcccagcattggaagaaagtcgcctgctgaaaccagccgggagccctgggaagagcagagcttcttgaggggagcacaggatgcaccaccacggagctcttgggagcccttgctgctgctcactacccatcatgcagcaggggctggaaaaacgagcagatgcccaggagttaatgacatgatccagaattacaccaggggcgaagctgttcagacagacccccagcctgcagggtggtccccatccaagccaccaaaatccctcagggaagccccaaagtccctgagcctggtacacaccccgtctccctacatcccatcaagacctgctctgagcactcagctggtcaccaggcacccatcccactagactagcccccaggctggtaaaggagaaatcacacacccttgtcacagtcaagcccttccttggggaagaagataaggccacacttcaccccacagaaccacagtgatttgggggggaaattctgtctcccaatggacagactggggagtcccagcatttcactgggatgcgctggtttgggaccagtgctccccatcagccaccctaactccaccctcaagttacttggtttcctgctgtgccacagggtaagtcttcttgtcaaggccccagcctttcgtgggagatccttctctagacctggccctgtcccaccctggaatgtgggactggaacccatacctgtctgtcggtcaggatccccggctctgggcgcttccaagatgaagccagaaggatgtagagcaccagcagcccaaaggccaccaccagcatcccggtgctgttggcaaagaccgcctcactgggcaggctgtggtatggcctggtggtgtttttcctgaagatgacaaaacaatgtgagccctcgagagatttttccacctatttttgtctagtgggagactcgatgtcactaacagagggtgagaaaaccttcccgggtccatatgtgatctagaattaaaacaccctttctt

SEQ ID NO: 13248 - DNA, 1244 bp, Homo sapiens
ctctgatcacagtggctttatctccatgaaggaggtgaagcaggctctggtcaactgcaactggtccttgttcaatgatgagacctgcctcatgatgataaacatgtttgacaagacctaatcaggccacataaatgtctacggcttctcagccctgtggaaattcatccagcagtggaagcagctcttccagcagttatgactgggacaactcaggctccattagctacacagagctgcagcaagctctgtcccaaatgggctacaacctgagcccccagttcacccagctactggtctccagctactgcccacgctctgtcaatcctgccagacagcttgattgcttcatccaggtgtgcacccagctgcagatgccgacagaggccttccgggagaaggacacagctgtacaaggcaacattcggctcagcttcaaggacgtcgtcaccatgacagctcggatgctatgacccaacccatctgtggagagtggagtgcaccagggacctttcctggcttcctagagtgacagaagtacgtggacctctctcttcttttcctgtccctctagaagaacattctcccttgcttgatgcaacactgttccaaaagagggttgagagtcctgcatcacagccaccaaatagtgaggaccagggctgaggccacacaggtaggggcctgatgaaggagaggatgaaagctgaatgtcccgacggccatgagcagttgagtggcacagcctggcaccagacgcaggagattctggtccttgtaatggagttagtgtccagtcagctgagctccaccctgatgccagtggcgagtgttcactggcctgttaccattagcacctgtgttccctcaccaggccatcctgtcacatgagcccattttctccaaagtggaatctgaccaagcatgagagagatttgcccctgggaccagtggcttggattccatcacacccataaatccttgggtattaacttctagctgcctggggctggccctgctcagacaaatctgttccctgggcatctttggccaggctactgcctccgcagctgggatccctcacttgcctgccacgctctgctcggcttccatctccaggggacagtggtcacctctccttgccaatactttttttaatttgcatttttttcatttggggccaaaagttcagtgaaattgtaagcttcaataaaaggataaaactaaaaaaaaaaaaaaaaaat

SEQ ID NO: 13249 - DNA, 916 bp, Homo sapiens
ccccgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggagttc

SEQ ID NO: 13250 - DNA, 3396 bp, Homo sapiens
ctcagatcacattggtatatctccatgaaggagctaaagcaggcctggtcaactgcaattggtcttcattcaatgatgagacctgcctcatgatgataagtgagtctccgccttgcccttgggcctgagctggggcagagccacctgatagtggacagtaggtgggtaggtgggtgggtggacattctgaagagaaattcattgaccagggaggactgtggggaggaagctaggttcagggtgagatcccctagactgagagctcttttcctgagatctttcttaagttctagaccctgcctagttacaggttaacttagtttcctcttctgtagaatggtactccctcccctgtaggaaacagcagggaggggtcaggtgccaagcctgcagagaaaatgcagttctggatggggtggggctaaaggtgtccagagtaggaggacggtgcaacgcttgatgtgggtgtctcaggtgcaggcatctgggcctcagggcttggttctgtgaagtcgcctactccagcctggagagaagggctgcctcaatgggtcctgagggggacccttggccttcagtcttgaagccttcctcccctcctttccctcctcaccttcagacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaaggtgcgggtcatggccggggcacgatgggcaggacagagctagactcttctctttacaccctaagatacaacaaaggggtttcctcttgttaccgaatgtccacctgcactacaaaatgctgttctcagtgcaggcctgcatccctcaccccttctttgacccagctggggcactgagccaagagccagggcaaggaaacacctgggtccagaatcagggctggaccctggagtgctgggtgagacggccccagccacagggagccttaaggatggaaacttggcaccttaaggactatgagaccagtgtgtgtggcttgggtgactcctttctctccagtttctagcatgtagaatggaaagagccctgaacagggctcagaaagatgggtctgttgccacctctgctagtggacagtttctttcccaacttttgggaccctgagcactctaaaagttgcagttggggaagatgacctgaggccacagccccaggtctggttccaaactgactgtgtaaggcagaaggccacagtttgggctcaggcaggttagtaagaggttgggggaggacccaagagggagctttgccacccaggagggagaaagggctccccagagagtctagtcctttgcccaggctgtggatttcattcagactaaggaggtctgtgggcaggagtgagtgcaccacatctgcccccagtaaaagggaggggagatgacctatagtaatcacctactcttgccagcttttgtcgtggatattagtaagggtgatattaaccacaacaaaacgtatttactgaatgcttgctatttttaataggcttatgtaattcattcttcccatgtgctaggtactatttataattccacacccttcaatgaagaatcccttataatctcccttttaccggtgagaaaactgaggtttagtgtaggtaacctgcccaagggcccgcataacaaatggagagctgaggttttagcctggcctggtaagttctgaacagaggaaggaaggaagcatcccagtgaagagacaggatgctccaagagaccttggagtgacagtgactttattaaaatagcatttaccaagtgctttttctgtgccagtcactgtgctaagtgctttacatgatcacccgttttaatccttactagaacctacaagttaagtattatccccattttagagatgataagatagggatagtgaggctaagcaacttgcccagtggctgactccagagcaggtcctcatacctctgctgtactgcctctgatgtctgccccaggcaaggtggtcctgggagctcaggcttccttttggaatgcaaacgaatcagagatgattgcggatagtccgttgtcgtctctgcaatcccctgagcctcagttgaagagacaataatggagatttggagaaagagggatgagggccttccacctaaggggagcatccagacacggtccctgttgtgtttctgacatcttagacagacccttgggatttctctaccctctttgtgcttctgtgcccatcctctcgaagttccttgaactgttgtgatccagtattcctgattgatggaggtgctcatggcaggtttttgtgtgtctggtctgtgtgcccctcttctccagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggagttc

SEQ ID NO: 13251 - DNA, 187 bp, Homo sapiens
cgggtagctactaccttggaccccccccagtagtggagggcagtatggcagcgtgctaccccctggtggtggctatgggggtcctgcccctggagggccttatggaccaccagctggtagagggccctatggacacctcaatcctgggatgttcccctctggaactccaggaggaccaaatgatggt

SEQ ID NO: 13252 - DNA, 975 bp, Homo sapiens
gatctgcccacctcagcctcgcaaagtgctgggattacaggcgtgagccaccatatctgacacatttataataaaaactactgcatttaattcctgcctcaaaatacagcctgtaaatcagacagtgtcttttttttctgagacagggtctctcattctatcaaccaagctggagtgcacctcattgcaaccttcaccttctgggttcaagcgatcctcccacttcagcctcccatgtagctgctgggactaaacgagcagaccaccatgcccgcccaatttttgtatttttttttttttttttagagacagggtttcatcatgttgcccaggctggtctcaaaatcctgggttcatgcaatccctccacctcagcctcccaaaatactgggattgcaggcgtgagctatggtgccaggcccagtgtctttttaatctttacttgctctgcattttaactctacgatcaatgaattcatggttcatcttatgtttatcttataacacacttcaaaagaaaggaaatatgatgttcaacctaacagtctttaaaacagagtataagttgcccctctgatacctcaggagtagaacttcctttcttaggcctgatttcaaaactacatattcactggcttctacttctcaactgttcttaaaactgagaatttggccaggcgcggtggctcatgcctgtaatcccagcactttgggaggccaaggcggatggatcatgaggtcaggagactgagaccatcctggctaacacggtgaaaccccatctctactaaaaatacaaaaaattagccgggcgtggcagcaggcacctgtaatcccagctactcgggaggctgaggcaggagaatggcgtgaacccaggaggcggagcttgcagtgatctgagatcgcaccactgcactccagcctgggcaaaagagggagactccatctcaaaaaaaaaaaaaacaaaaaaaa

SEQ ID NO: 13253 - DNA, 1182 bp, Homo sapiens
  misc_feature (579)..(580): n equals a,t,g, or c
  misc_feature (589)..(590): n equals a,t,g, or c
  misc_feature (595)..(596): n equals a,t,g, or c
  misc_feature (599)..(600): n equals a,t,g, or c
  misc_feature (602)..(602): n equals a,t,g, or c
  misc_feature (612)..(612): n equals a,t,g, or c
  misc_feature (617)..(617): n equals a,t,g, or c
gcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggtgattaaacgagagcccagttnngatggcccnngtganncanncntggttacaanctggncaagggtaaggggtggggacaggggcaggaaaataagttctgagcagcccggaaataatgagtggtgactgcttctcggggctttgcctgccagcagcaccactgtgctctcctggtcatggtgcacggagggccagcaggtgtggggccctgccacaccggaacagcaggccacagcagccatgctgtccctcatacgcacacgccctctatgggctgcagagtgttaccatagcatctcgtaagcctcacttcccaccggtagtaggatattgtcactcatttaacaggtttgaaagccaagctgcccagggaagggacttctcaaaggtcgcgagtccagtgagtggcagaagggggatgtaaagccccagcccctctgatggagtgtccagcgctcgtcccgtgccctccacgcccctgtgtacccagctacttgtttattcatttggtttatacgtttggtcgttcattcatttggtcagtgcacattcttttatggccacacacctgctagggcagtgaataaacggatatggaggcaaatccactggatagtttgtct

SEQ ID NO: 13254 - DNA, 9947 bp, Homo sapiens
ctcagctgtggcctgggcctgtgctccaggccagggcggcccagggtggaggtggggtggggagcgtgagtcctcagaaagtgacagcagcaggcatgtctaacattttaacaatttagttaataagcgattttataccctttcctcctccactctcctgcttttgaatcaagggcaaggttaacacaagtgacctggcttcttgctttccagatcctaaccagtacagctggggagagaactatgcaggcagctccgggctgatgagtgcatcacccgagctcggcccggcgcagcgggcgcggagtggcactgtgagtagtgggctctggccgccccgggccccaggggagcagcctatgccgcactcacctcgcctgtccctgagcgaagcctcttgtggctgtcccggctgaaaggcgcctctgcccatggcgaatcctcccatggacctggggtataactaggggcaagagaaggacactgtggcttgctttcccatctccctcattgggtgctttcgtattttggaaacattcagcaggaattacggagtctgtgtgatccggccttcttgtttgcagagagattgctaaagttcaggggtgacggggacctctccccacgccagaaggcccgtccactttggagttgaaacccgaaaccgcaggagccacccagggccctgcctaggactgcgcgctctgccgcacactgccgcgcactgtggctgatggtctgtcggttacagtctgctctcctcggggtgtcccggctcattccttggatccccagtgggtttgccctggcctgagctgggtggcactggcgggctaggagacgcaccccatgtctgccgagttggagctgctccggaagggtcccccgccaggacctgcgtcagccacgggatgcccccagcacagccccacatggcaggaaccgccccgtgtcacaggctgtcagggtcctcgaccgtgcccccccgcggggctcattccttctgtagctgtgagcagttaacctgaggtcacgcacaaagctagtcggacccctcaggacaggccgctggcattgttggcaggaagttgcttgtcatttgtagacatggggttcagtgtcagtattttcaagaccgcgacttgttgagttttggcttctcaggagggcgcctcccttttgtgtgggtcctgcagttcacaccaggccacggcctcgcacagacgcaccacactggccgcagccctggtctgcctttcccaccgccagcactaggcaggggagtgggggcgaggctctgggggcctggcagagccccaggctctcagcttttgccctgctgttgggcagaggggcttggtgtcttccagcctcagtttctgatttgccaagtgtgcataatttgccaaatgtcctggactgtaacctggagtgactgcgtggacggccacagtgcttcgggggccccgttcaggaggcgcttgttacctatttggtaccccaccagtggcacagccctgccaggcaggaggggcccccaccttactgaggatcaaactgacatgcagagagatggagtcatttatttcagtttatattgtccaaaaaagtcaaagcgaagatttgaacccatttgtcaggatagaaggagcctgcgacctggcaaggcagcaccaggcgatcccggctgtggtccgtggtagttaaggtggggctcctgccgccttctgcactggctttgggaagtcactggctttttccacgtggagcttctgcccggcatgggcttcccacctggaaggcgtcccctttgctctggaggtccctgcccacccagaggctgcttctccagccccaggggttgccagcaggggtgccccagtggagaagggcagagggccagcatgtgacctgtggggtagccaccggagggtgggaagaggcggtcagctacacagttcccctcatagcccctctggtcccagagcagcggctgctgcggtgagcgtgcagagagccgagtactgatgtgtgcgtcggctcagttcagttcacttcctcccggcataaggtagaaaaagccagcagggcccgtgagcgcgcctgtgctgggtgcaggtggccccggggtgccctgggtgcataatggcctggccctgccatagtccttcatggacagaacgtgctgggaggcccggcagccatggaggaagaagggtgcatgtggggcgtggggactccctgcccggcacggagtggaacactgcctggtgcttagtgaggacagaaccccaaacctctgtgtgcagacacggccacctggaggaccagaggtgggaacagtgtgactgcaggggtcacgggaggaggtgaaactgtaggggtgacagggaggggtgactgcagggaggtggtgatgggggagggagttactatagggatggtggaggaggggtgatgggagggtgactgcagcggtgattggggaggtgtggctgcagcggggaggtgctgggggcaggaggcgtgtggtgggagcagacgcaaccccagtgtcaaaccagggggtaagtcaaggtatccggctcaggccgccgggcagctgagggggcccagtgggggtctcgtctgtggcccagagacgtggcggaagaaggcagtacatctcccttcttagagagagagtggaagcttctgagtgtggcttgggtcgttctgaaccatggtgacgtttccaccctgccactgcctgtcttccagtttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtgagggctccgggtgccgtctagacgattccaaggccgcagccgggttaaccttccaaggctccgggggcaaagccaaggtggcgaagggggacaggccagtgttgtccagaaaccccttgatctgcgtctgagtgagggggcgattttggtttctcaggcaaaaataccgctcctggccacctggtgggtcagtgaggacgtggcgtctgcgaggcacgttgcttctaagggcagctgatagttctgctagctagcacattccttcaaaaagcaatttaggagacgtctctgctcttttgaggtgtgactgaggtgcgggaggcattgtgggaccctgactctgggggtggggtgagactcagccccagcaagctcccggcgaggccaccttgggactcctgcgtcccaccttctccaaggctgggctggtcccgtggagcaaatgccaggccctgggccacgctgcccctcaggagctcagctcggggccagggagccccggtagcaacacgcactcttcacgaagccctcggagaggccgggtcgtgccagggtttgtcctgagggaggagtcccagccctgcccaggacccggagtgagctctgagtgcccagagcccctcgtccccggcacaggatgggggctcgagtctgaggacgtgggtcttggcctcgggtttcctggggggtgagggaccaaggtcactcctgctcctgcctcccagggcaactgggaggggcgaatggcaaagggaagcctcgggtgaccgtgaactgtcaccgtcagcctttcctgttccagtagaaactgccctgaccacagcccaggcagcccccaccctgcccgagtcccccacagcaggccctgaccctgccccgggaagccccccatagctagcccccaccctgccccaaacagcccccgacagccggctcccaccctgcaccaggcctcctacagccgcccccaccctgccccagacagtcccccacggccgacccccacccttccccgagccccctgctgtcacgtggggattcgcaagcagcagggccagcgcttgactaaccccctccttctgtcgctggcaggtagtgaagcgcgcagtggcgagccagccagactctgtggatgcagccgagagggcggagaagttccggcagaagtactggaacaagcttcagaccctgaggcagcagcccttgtaagtgcccagcaccccggtgtgtggccacctcttccatccagagggcccctgcacctctgagaaagtgccgtgatgttggcattcggaccccagctcgctgggggtgggtgtgggccctggcggcacagcccccttggaccccgcctcaagcagcgtttgcactgccgggctcctgaggacgtccgtggcacagccgaggatggcagacgggcgggtgttcggcctgccctgctcagcgccctctgccgtgtctgtccccagcgcctatgggaccctgaccgtgcgcagcctgctggacaccagggagcactgtctgaacgagttcaacttcccggatccctactccaaagtaagtgcagtgtgccctggccttccgctcgctcttgtccccgtcccgctggcaccgcgtgtcctgtctctgtcccgctggctcggggcatcctgtcctgtctgaggccatgcaggtttggtagcggccccaactccagccctggcaccacaatagccagggcctctgttggcagcatctgctgaggagctgtgttacccccacagatgctggggccacttaggggtggggactgctgtgactagagaagaagggtgtgaaccccagtttggatgtgttcctgacagacacaggctgcctgcctgcaggagccaagggcctcccagcttctgtgagggtgggcgattgtggttggggactgctttcccctcatggggaggggctggaaccctggaccaccctggctccctcctaggaggctggacagtgaccagaggcctcctatcccggcaacgtgcagggccgtgcaaggtgggcctttccgggcgtccgttttgcttccccaagtctggcggccagagccctccttggccctttctgccaggaggcagcgggcagcagcggaggcatggactcctcccacctcttctgggaagggccagcgccatgcctccctcccctcacacgccgagccttgtgacagcggaagtctgggtgtcgagggttttgaggccagggctgtgggtacctgtgggggccgtgtcctccactcttgtcctgcccttcacccactgctcagtcacatgggggctgaagttgtcctgggcctcgtcctcagagccccgtgcagctgtgcgctggccactgtcccggaccgataggcttgtgcctggtggggtcccagttgggcctgagtcttcgatcctgaggggcgtggtatggaacaggctgcgcctggcaggtgtccagggtgggctgaggccacgtcttcactcaggcctggcatctggcactctccacaggtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgcgtaggtgtctgcgggctcggagcaggctctgcagcctgtgggtgcctgtcctgccccaggcttgcgggcaaggaggtggagcgggtcccttgggggtcacgtggcgcttggtggcttggtggctcagggctttggggcccagggagtgcacatggcagcagcgccaggggctgggcagggcgcagcgcccttgtctgtcccctcaggttctgaggaggccccttccttaagcatgggtgccgcagaggcctaagggtgtggatttgaaaatcggggctggcattttctattgtcagaatccaaattcatgtttcctatgtgtggtaggaattaaacatttctgatgtgatgatcaaagggtgctttgcaaagcagtcccctagactggcctgtaggacacgcaggtgtctagcacctggcgccgtctcctggggctctgaatcttgaaaatgaacccccccaccatcatttaccttcactcccaaagaagctgcttccagtctctgggcctccccaggcggccgcaccacctctcgtggtccctgctttttttcatgtggggctggagggaaatgcctgggttctcagccctccctgggtcccactcgtgtctcgagacatagatgagaacgccgcctccaaccatggctgcccctctgggacacaggcccctcccgcagcctgtcaggagcattggaggagggtcctgacccatgggattggccttgtggctgggggctccccacaccgcctgcatgggtgccaagcacagggaccatactgcggctgccagtcaccgagaggcttccctggccccgtggctccgagtccaccttgagaaacagcctgtgctctctcagacctttgcttggtggccccctgagccttctgcggatcgcagcatgttaagaacgctgtatctgttctgcctgggagtgatttggggtcttcacgttgagcagctgcctctgtcccacctgggagggatttggggtcttagcagctgcctctgtcctgcctgggagtgatttggggtcttcacgttgagcagctgcccctgtcccacctgggagggatttgggatctttacattgagcagctgcctctgtcccgcctgggagggatttggggtcttcacattgagcactgtggctgaaggtttttgttctgttgtcttaattttcttttctcctcctccatgcagtgtccttgaatccgacccctactttgggtttgaagaagcaaagaggaagttacaaggtacggatggccaagtaacttggggccttgccttgtgctggggccatgcctggacgttctctgcaacagcgaatgcagttgcggtcggggtccaggcacctcccctgctcaaggctctgtcagctgggcttcgggggcggggagaacttgcttcctggagagacgaacacctgaagacgcgtctccctgacccctgacctggagcaccgggctaatcatgtgtccctctctctgtctcagaaagaccctggctcgtggattcctacagcgagtggcttcagagattaaaggtatgtggaggggcctcccacctctgctgctggggacacagcggggcccgggggggtggtcactggagggaggtgggcatgggctgcctcgggtggccctcccctcctgttagagtctcaccatcctgcgagccaagggtctcagcatcccctgccccacacttgccctcctgtcgtgactgcttcttaggtcacctgctctaggcacaaagccttgccagaagagacaggcactggcccctgcaggccaatccgtccctggcgcctctggggtcctgaagccccagtctcagcccctgcaggctggcccgtcccggtgcctctggggtcctgaagtcccggtctcagcccctgcagcccagcccagtcccggcacctctggggccctgaagcccctggtctcggcccctgcaggacagcccatccctggcatctctggggccctgaagcccccagtctcggcccctgcagggcagcgtgacgggcagcaggggtgcggactgactcgcttggatgcgcctgttcccaactgaacgtcctggttttgtcttacaggggccccctcataaatgtgccttaattttcgcagataacagtggaatagacatcattttgggagtcttcccctttgtcagggagctactccttagagggacagaggtgagtgttgaggtggtgggtggggcccttcccctgggcttctctgctctcggtggggttggcgccgctgtgggcctctggcggtggtcggggctcctccggacgcagcaggtaggtgcaggcagcagcacgggggaggcggcccagagccgtcatctgctggggtggaggctccgagccccctgggctcaggctgagggtccatgtgctgaagcccagggttgacgccaggctcctggaagggtgctcacagcaaggaggctttggggctgtgacttcacagacaggcaggtcccaggggcaggctctaaactcagctctgcccctcggctcagctccctcccaggggccacagagtggcaaggtcaggcgaggtccctgctcctcagcagcaggtggctggccaggcccgctgggcacagcaccctcacccagcccagccactcgaaggccggggtgcacgcaggctccatgctgggccagcacaggttcctaaagagcctgggccctcctcctgcaggtcatcctggcgtgcaactcaggccccgccctgaacgacgtgacccacagcgagtccctcatcgtggcagagcgtattgcgggcatggaccctgtcgtgcagtgagtgttggcgggcagtgctgggggggccttgatggggaggggcaccagctgggcagagtgggccatggggattgtcactgaactgggagctcctgggggcactgaccaccttgtatctggcagctctgcgctccaggaagagaggctgctgctggtgcagacgggctccagctccccgtgcctcgacctcaggtaaccccgcaccctgcacctgttctctccctcctgggctctgtgccctctgtgccgtgcacctgcacccaggtgcatgcgggacaccgacctcaggactgcccctgcggcctctcctgaccccaggcccggattgatctcaggaggggacagatatgccatccccgaaggtggcctggggagggtgaatggattcagggtctgaggtggttacacatgggctgggtttggggacttggggcaagaggggccaatgtccctgtggccactcagctgagaccgagggcgacctgggcagctgcccggtgtctgtcacctccgtgtcccacatagatgccaggctctgcttctgtggttctggaggtcattagtcaattgtatgtggtgctgtctgtcctcctgattgcagaggaggaaggaaccccttaaatgagcgggttctgagtgctggggccgctggtctgctctgcctggtgggattctccagtgctggcttcatctgtgccccagccccactctcaccaacaaggagggcgtgaaaatgacaaggaatccatccctagagttcacaggagatctagggcagagtttccaagctgcagctgctctggccctgtgtgagctgctgctctgaggaagccccaggctgaggcagctaccaggcggaggctgggtttggaggcctccacatcagggaattgagcggtaggggtttcagccttcacgttggtcgccgcactgtatgggaagtggggtctggggtctgcttgcccagtctcaccgtcctcttcctccccaaagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccgga

SEQ ID NO: 13255 - DNA, 1978 bp, Homo sapiens
attaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaagtgagtggggatctcaagggcgagaaaggaacatgtgtctgcccccgagtccctgggtgtcccagagccgcgtccctggcgctcgtgtgtcagattgcgcatggggcatggctgccccttcggaccaggcaggcttgcatggttgcacctgtctgtggcccagactctttaaggggttggcgcttccttttcagagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtaagacccggcttcatgaatgaatgagtggatggtttagccatagtttgttaagccctcgctgtgtgcaggagccagggctgggcacatggatggggcccagtgggcgggaggggggtggcgaggctgtgagctcagagcctctgtgggaggggcatcagcgcccccaggcttggccatgagagtcctcccactggcggttggggtgggggcggggttcaccccagcgcagcacatggggcggggggcgggggagcctgtgtggctgagggcccactgagggcacacctgccctggctctgttgcaggtggagacggaggacaggttcgagtgggtcggcggcagctccattggaggcggcaccttctgggggcttggcgctctgctcaccaaaacgaaggtatgcggcagctgccagagaccttccaggggtctgcggagatgtctgcttccttcccccgaaggcctgcagctgggcggtgcaaaagctgcttccgggcctccctcctgactcgcgtcagtgggtctctggcctctgcggcttcactctttgcgccctgagggttgggtgtcccagcaacccagagcttctatcctggctgggtggcccgagggtcccgcttgccgcctcctgcctttggtcccacgcgatgagggcccatttaccccctgcccgcgcgtgcctcctgccatgggcttggtttctggggtcgtggggattccagcagctcctggcgcctcacccgccccctcgccgtgtcctgcagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaaggtgctcaccccggcctctgccgccagagagcaggatggtggggacacttggggtctcacggacaggagcttcccccaccattgctttcccacaactgctccctggagagtcggggtcttgggtgtcagccctgtaacctcttcctgccgagtcgctgcagctcaggcccactgctcagaacgtcggcagataaacgccacggtcttggttttggaagaaaaaatagtttcctgattgggttttttcctccttcaaaacaaagcttaatccgtccaggaatgattcacacatcacacgcagcctcccgcacttgggctccagttcccccactcagctctctctccccctcccctcccactcagctctctctccccctcccctcccactcagctctctctccccctcccctcctgctcgctctcatgtcgtgcacttgctgtacttggagatgagtgccttttccttcccttcctcagagttctccaaagaagacatggcgaagagcctgctgcacatgatcagcaacgacattggg

SEQ ID NO: 13256 - DNA, 2029 bp, Homo sapiens
gtgtggacactgggttcccccatggacagctctggaatccttcagggctgggggttggatgcagaaggccactaaggggacacatttctgggaacctggtgctgggcctcacatgctaggtgctgggagacgcggaccatgcgatcttgtggggctgggatttggggtccttaggggctgggcggctagccacttgtatgcgtaggggctgggctcagggcaccctaaggggccggatttccaggggtcccatcttggctgtggtggagagctggactcaggtctctcttgggggccctggggaccagagccacgatcccggtgccctgatgtccccgtctcttccccaccttcctctcccccagtgtctgcctcaggacgaggcgtgcgccgacactggcagtggcagcgccgagggcctggctgctgacggcccccacctgcacacgctgacgcagcctatcgtggtcaccgtgccgcggccgccccccagtgagcacgcagtcctcctccgcatggggccgtggggcggcagagcgggtgggaaggacgcctgggagctggacccagtctcagcgtggcacttcccacagggccgcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcaggtaccgacgacctccgccaagccgggcccccagtctaatcccgcgcgtcgggacccggggcggccgcgatcccgcctgcggggcctgatcaaccctagctaggcctgcctccgcgatgcccgcagcagcccccaggggccgcccttagcctggcgtggcgcgcagcagcccttctgcagctcgcctctcccttccagcgccccacgcccctggcccgcccgcgagagcctcgcccagcggtccccagcccaggaggtcccagtgaggaaggtaggtatggaggtggagggagctgggtgaggtaggagatctgacagtgacgcttcctagcgcttagttcgtgccaggcactgtggtttttttgtttgtttgtttgtttgtttgtttgttttttgagacggagtttcgctcttgttgcccaggcgggagtgcaatggcgcgatctcggctcaccgcaacctctgcctcccgggttcaagcgattctcctacctcagcctcctgagtagctgggattacaggcatgcgccaccacacccggctaattttgtatttttagtagagacggggtttctccatgttggtcaggctggtctcgcacacccgacctcaggtgatcctaccgcttcggtctcccaaagtgctgagattacaggcgtgagccactgcgcccagcctccaggcactgttgtaaatgttttacgcctatgaactaacttaatccccttaacctctaggcggacactattataatccccattttagagacgagaatgatgaggcattctctgaattaagtaacttgtcaaaagtcacaatactgggtggagcttggattcgaactcaggcagtgggtcacccgcggcaggcgcgggctttgggtcgagccaggggcattaggtgaggagaggcactaggcgaggagaactcagcattcggacccggctcccactctcaccccggcatgcagaccgatggaagaggctagtggtctgctgggaagggaggtggcccgcgtagcgtcccctccctcgctgagcctcagccacccctcccagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaagttctggtgcagtcagtgagcgcgcaacgtgcggggtgg

SEQ ID NO: 13257 - DNA, 2029 bp, Homo sapiens
gtgtggacactgggttcccccatggacagctctggaatccttcagggctgggggttggatgcagaaggccactaaggggacacatttctgggaacctggtgctgggcctcacatgctaggtgctgggagacgcggaccatgcgatcttgtggggctgggatttggggtccttaggggctgggcggctagccacttgtatgcgtaggggctgggctcagggcaccctaaggggccggatttccaggggtcccatcttggctgtggtggagagctggactcaggtctctcttgggggccctggggaccagagccacgatcccggtgccctgatgtccccgtctcttccccaccttcctctcccccagtgtctgcctcaggacgaggcgtgcgccgacactggcagtggcagcgccgagggcctggctgctgacggcccccacctgcacacgctgacgcagcctatcgtggtcaccgtgccgcggccgccccccagtgagcacgcagtcctcctccgcatggggccgtggggcggcagagcgggtgggaaggacgcctgggagctggacccagtctcagcgtggcacttcccacagggccgcccaagagtgtccccggccgtgcagtgcgccctgagcctcccgcgccggcccccgcggccctggaacccgcgccggtggtggcgcttggtgttggcagccttcgtgctgggcgccgcgctggccgccgggctgggtctcgtctgtgcgcactcaggtaccgacgacctccgccaagccgggcccccagtctaatcccgcgcgtcgggacccggggcggccgcgatcccgcctgcggggcctgatcaaccctagctaggcctgcctccgcgatgcccgcagcagcccccaggggccgcccttagcctggcgtggcgcgcagcagcccttctgcagctcgcctctcccttccagcgccccacgcccctggcccgcccgcgagagcctcgcccagcggtccccagcccaggaggtcccagtgaggaaggtaggtatggaggtggagggagctgggtgaggtaggagatctgacagtgacgcttcctagcgcttagttcgtgccaggcactgtggtttttttgtttgtttgtttgtttgtttgtttgttttttgagacggagtttcgctcttgttgcccaggcgggagtgcaatggcgcgatctcggctcaccgcaacctctgcctcccgggttcaagcgattctcctacctcagcctcctgagtagctgggattacaggcatgcgccaccacacccggctaattttgtatttttagtagagacggggtttctccatgttggtcaggctggtctcgcacacccgacctcaggtgatcctaccgcttcggtctcccaaagtgctgagattacaggcgtgacgactgcgcccagcctccaggcactgttgtaaatgttttacgcctatgaactaacttaatccccttaacctctaggcggacactattataatccccattttagagacgagaatgatgaggcattctctgaattaagtaacttgtcaaaagtcacaatactgggtggagcttggattcgaactcaggcagtgggtcacccgcggcaggcgcgcatcttgggtcgagccagggcgattaggtgaggagaggcactaggcgaggagaactcagcattcggacccggctcccactctcaccccggcatgcagaccgatggaagaggctagtggtctgctgggaagggaggtggcccgcgtagcgtcccctccctcgctgagcctcagccacccctcccagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaagttctggtgcagtcagtgagcgcgcaacgtgcggggtgg

SEQ ID NO: 13258 - DNA, 2918 bp, Homo sapiens
gcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgaggtgagatgcggttctcgggaccggagccaggctggaggcggggctggggtggggcggagagtgggcggggctgcggcaggagccagcggggcggggccaggaatgtaagcgagcgggggcgtggcgtggggctgagtggcggggcgttagtgggtgagcctgggcggggtgaggggcggggcgtggacgggaagagaagacctaggggcggggcgagcttgggagctagacgtgggcggggcataagtgaagcggaggggcggggcgatgccgggggcggggcgtgcgtgccgctgaggtttggagagtgggtgggtgagtttgaggggcaggacgagcctgggggcggggcgtgggcgggttaatagcaagacttaagggcggggccgttttgggagtaaggcgtgggaggggcgtgggcgggatgagggcaagctttaaaggcggggcgagcctcggggtaatgcgtgggtgaggcgagggctaaacgggcggaatgaactgggagtaagatgctgccgagtccgggcgaaaagcaacgcatgctgttggacaggatacgagcttgaagtgagagggaatagagaagaggggacgaagaagggagttgaacggggtagtagtcagcatagggttgggccctggctgcgtgaaggagccggaactggcctgggccttacaacttccttaggtagctggtcacgctctgggtggggtaggggccttggcagtcactgggactcctaacaccgggccagcaggagactaaggcgcagtagcggggcccagagcatacaagggattgggctttggcttctctgctgcagccctgagctcatagaagcctcattccgccgcctctttcctttctagatccgggtcttcctccagcagctcaagggccgcgtagcccgggaggccattcagaaagtgcatccgggtggccttcagggaccaaggcgccgggaggcacagcccccagcccccatagaggtgaggcagatgaacagggtgaggctgtccagggcaggtccctggtgggtaggtgggagttgcgggggataacctgattaggggatccccaggaggagcagggcttggggggccattgcaggctgatccctgggctgaccctgtacctctggcttcactcaggtctggacggatctggctgagaagataacagggccactggaagaagccctggcagtggctttctcgcaggtaccgccattcccccaggcaggtcagggtgtcccagaggacagggtcacatgggccaaatcatgtgaacctgggtcctgggcccttttgccagctctgtggactccgtcagtcactggacacctcgagcctcagtgtccctggctctgaggccatctcttgtctgaggagcatcttagggtggcagggaggatgggggaatgtgtagacggtgagaagacttcccagctcctcttcctccctgattgttctgcctgccaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctggtgagaagggtgagggagggggcaggagcagagggatcaagggtccctggcagcaggcaggggtgtccccttacccctctcctccatccatcactagagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 13259 - DNA, 247 bp, Homo sapiens
cgttttctctcctttgggccgcccttccccgccccgccagctcccccgttccccgcggcgcccggcccctggctgcgcagacccctcttcagcctgaagctgtccgacacagaggacgtctttcctcgccgcgcggggccgctcgaggtcccggccgacagccgcgtgttcgtgcaggtggggaccccggggacaccagggtgcggatgggggccggtggggacgggcgatccctgatggcgcctcc

SEQ ID NO: 13260 - DNA, 243 bp, Homo sapiens
cgttttctctcctttgggccgcccttccccggccgccagctcccccgttccccgcggcgcccggccctgctgcgcagacccctcttcagcctgaagctgtccgacacagaggacgtctttcctcgccgcgcggggccgctcgaggtcccggccgacagccgcgtgttcgtgcaggtggggaccccggggacaccaggggcggatgggggccggtggggacgggcgatccctgatggcgcctcc

SEQ ID NO: 13261 - DNA, 18385 bp, Homo sapiens
cgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgggttgggggtcggggatcggggatcgggggtccggttgggtcgggttgggctccaggtctggttgggtcgggtccaggtcgggtaggagtccggtcggggtccgggtacaggtcggggtccgggcctggatcgggggcgggtccgcgtgcggctcctctagccccgaacccgtgttccccgtaagctgttggtttctaaggggcggaggaatggcgactggagccacctctcaccgctcagggagccgggagggccggcagctcccgcgggccgagtttcccgccttgggtgcgaggacgcgtggggccgcgctgtgcccggggaacactcaccagcatctctagcctccacctccctctcgcgccagtggcactcccggttgagacaactgagaatgttccctgggcacagtggcccgggttgagaagccctgcagtggctggtagcgttggggtccgagcggaggagcgaactctgggtggaaaccggcaggcactggaggggaaggaggcgggacagggttgggtgggaccagggttgaggggtgtggggtctcggggcgctcaccgaggggcttcctgagcttgtgtggattatttccgtgccccaagctgagccctgtgtccatgtcacaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcggggtgagtgggctgggcccatcctggggttgccggtagcctcagaagtgatgagagtggcttgaaggactggaccaagagcctctctagtccctgtgaggggctagagagagagcctgctcctggctgaacccctgaacagaagaagcggtctgtgtctgtctcctttgcgacgggaggcacctgctgtgtctcacaaagtcccccacttgctccccgtccggctgtgtcagagagggatggggtgggagtgttcacatcccaggcggcagaggcagcccgtcagctggggacgttccaggttttccagggaagcacagctgtcatcactgacacgtgtcccatgtggactcccagccccagccggctcccaggctcagcctcagatcacactgcagtccttgccgggacactgcatcttgagaagctgggttttcagaggttgctgtgatcaaagcaagcactgagttatccgcgtcagcagcaggggaggggtgtccagtgagactccaggttggggaagccgctcagggccccgagagctctcacacagtaatcgcagttatttaggaatggattaacagattttcccatccggcttgtggttttggacttcacgctggttatgttgttggggctgcccgtgtaatccgggctgctggttccttgtggcaggaagggggccccgaggatgggggttggcggctctgcccaacacgcccgtatcttcagccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtgaggccctgcctcggggaccccctttgccacccgtcttcttgggtcctcgtcccctgccaccctctggtgcctcacggcctctggagactttggagtctctggttgatgccgtcaggcaggtggggatgtccctgtcccgcacagtagtgaccggcagggctcatccgctgtgggctgaagtccgctgccctccacgcgggcttctcttgtccctgcagtcccttgggtttccagggcccaactgtgctgtggtggccaggtgggggatctcgaggttctcaggtctggaggcagacgctggcggtgccctggagagggggtgctgtgggaacggccttgcccgctgctgggctgcagggccccgtgagcgcccatgctcgctctgttttccctggggcgccagatggcggctgccgcgagtgtgcgtttcactagcgagaaggaggctgggccgggggcctgcacagcacccggagcgtctgcctctccctgcagggtgaccccttccttctcttgcctttcccgagctccaggcgacagctcagacgcaggtcgagcacctgggtccggactccaccctccacatgctgccccgacctcgttctgaaactccctccctcgctcaggggcaccctggggtcctggagcagctcggcgccccctcagagcccaggaggaagccgggcccctcgagtccctgcgtggggcctgtgtggcccaagccccctcgcctcacctgggggttcctgcagcaacctcctgagcccctcctgtcttttccgaacgtagccctaggcttgcagctgctgctgtgcatgggcccatgtattaaggaggctttgggaacatctcggacacatgtggaatgcggctttttcacgtgttcggggttggctggggccgtcctggtccccacgcggctctgtgctttccgctgccccgcgtcccagctcttctgtggggctggtacagcccggcccctcccggttccccacgttccctggagtgcgctccttccctgtgggcggccgtggtggtggtgctgctccagggtctcatgcccggctcagggcccaggcctaccctgcgtggctgacccaacttggccgggccctatcgatgctttctctccttcctcggcaacatcataccggtcccgacctcctacaccatcgtgacgattaagtgggctaagatgggtgaaggtttgaaaggattgtgatttgcttgtcaggttccacgcactcctgttcagatttgctgggtaggctgatgggcaccagccgttgttttgagtgagttttgctgtcggttggagtccgcctgaccgagagcagctctccccacacctagatgttcttttgtgccttcccgccggcttcctcatcaggcctccctttctgtcccaggtggcctggattcctccgtgtccttcgtgtctcaggtccttgggaaagcctgtgtccacgggaggcagcgtgagtagagcagtgccttcctgcccatcctgccccgaccctcacagcccatcagccttctgcagaaggccgagaatccctcctgaccctggccctctgcagggtccccttgcccggtcctgtcctgggcccgtgggatctggggctcagctgtgcttactggggagctgtgggactgtccttgctggacccacacagccccagacaccaggtgggtgcagctccccaggctcaggtcctccgtctgtcccctcagaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggtaagcagccaggctgtcctccagctgcactggcttctggggtctggacccccagaggctgccattccttcacgctacttctcctgggcgccgtgctgcagctggcacccccatgtaggtgccacagggtgtgggtggtgccctctcagttcccgcacgtgctgatggtgacctctgtatcagagggtccctttctcttatgaaatagcatcgatgctgtgaacagcccacaccgtaaaggcgcctgtaccttgggccgtccacccgtcctgcgcctgtggtccccctcgcacacgtgtgcaccatgtccaggctctgacatggtgatgggcggtgactcacttccccacgtctttgtgcaggagaatcaaggttgcatttctggaagcaggactgccggccatttacccccacaaaccctgccagctcacctgcctcagatgtctcccctcccttcaacgtgtgcaaggacatacctgtctctgcccaaagtatttcctcctcttttttttttttttttctttttgagatggagtcttgctctgtcacccaggctggactgcaacggtgcaatcggctcactgcaacctccgtctcctgggttcaagtgattctcctgcctcagcctcctgagtagctaggactacaggcgcccgccaccacacccggctaatttttgtatttttagtatagacggggttttgccatgttggccaggctggtgttgaactcctggcctcaagcaatccacccacctcggcttcccaaagtgttgggattataggcgtgagcccctgcacccggctgactttgcattcttgattctgggtgagggtgtgtgtgtgtttaaggcatttgtattcttttctctgtgaactatataatcatgtaatcacattctattttatagtttgttttggtgttgttgttgggggggattgtttttagagacaggatcttgctctgtctcccaggctgcagtgcagtggtgtgattatagctcactgcagcctcgacctcctgggctccagcgatcttcccacctcagcctcctgagtagcgggaacacaggtgcgcgctatcatacccagctaatttttaaattttttgtagcgacggggctcactttgttgcccggctggtctcaaactcctggccttaagtgatcctcctgccttggcctcccaaatgtttttttaaccgttatttctttgtgtggaattttaagtgataagtgagggagaaatccagccatatctgtttccacactggctggatagacttgtggggctctttctggagacccataacctctcaccgggaggactctttcagtctggaccaggggcctacaggctacttggacaaaatttggcccgctgcatgtttttgtaaataaaatttttttggcactgtcaaaggaggccttcgagggtggacccgcctccgcccgggctgaggtgcagggaaggaggctgtcgggggtggacccgcctccgcccgggctgcggtgcacgcgctctctgggttgtggcatttatgccccagagaagggaggatgaaggcccagctcaggcagtcggaggatggaaccagaggctcgtggctaggaattggcaggccgggagtcaggccgccgtctgtgggcatcggagttcacgctctcgctcctccctgtctccaggccggcttgcagctctggcccctgactctgtcttgcaggcctgaggtcctttcgagactgctggggaacctggtggtgaagaacaagaaggcccagtttgtgatgacccagaagcttctgttcttacagtcccggctcacggtgaggacgccacggagggtgcaggctgctggctgccccatcacagcaagaatggctgcaaaacatggggtcggagcggtgtctgctgcctgggagaccctgcctgtgatttggcagtggctggcaggagttggcgaggcggtgggtgcctccctgccctgatgacaggccctgctgtgacggctctgagtgagggcttctcatgtgtcaatcttctagactcccgagaagccacccgccctagctgcgttctgtgccaggggcctgagggggtggggtggggtgggtgggggataggtgaggacacagaggaggtcgtgcatttccgggacttatgactcccgtccccatggcctggagcccggagggggtgagccaggtcccctgagcccagagtgggtgagccgggtcccctgactcccggccacatcttgcttcaccctcctcctttgctcacacgagaacttaagatggcgaggccctgccccagcacggcagcagctgcatcctacgtttttatatggaaccgttttatcacgttcagttcaaaggaatagaggcgggtgggtcgcttgagcccagggggcagcttctgcgggaggggaggggtcccgcattccaggaggcagtggccgcccccatgcttgtccgtctgctgccctcagtctggtcccagtcctggcatggctcttggccttgggagccccgggctggccaggcggcggcctcagcccagtggacaggcatgtgcttttattgcagacgcccatgctgcagagcctgctgggccatctggccatggacagccagcggcgcccgctcctgctgcaggtacgtgcctcctggctctccgtccctgcgaggccctgggagaagagccgtgcggggctcaccttttgggcggcagggtgaggctggctgggctggggcggagctccctcagagtggctgtgggcctggcggggacagactggccccgagccccacacagtcgtgggccatgccacctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatggtgagcgggtggtttgggctccccccggcctcgggcgccccgaggtgctcagggggcctgtccggtgcttgcagaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccaggtgagcgggccgtcccctccgcgtccccgtgtggctggcccgggtctcccgagcggctgcctctccagccccagggtcaccgcctcttcccggggtccagacttgcggagcgtccgtgtggacttctcgcagggctgaggctggaagctgtggcaggttctcagccctgagctcctggggccacacagggtcgggtgagcacagggcccccagaaggattgcctggacacgttcacagactctctctagacgggggcccgagggaggctggggttaagggggccaccccctgcagtttgtccggccggggctgcagggcagccaggtcgctctgggtcggtggccgtgggtgtcagcctctctgctgccggctgcctggccatggaggagccctgtctgccttcaggctgtggaggtgacggcctgtcctcttatctgctgagaacctgggatctctctggggcattggccttgggggaggcccagctccttcgagaggggccacggcccctcagctttgagcactcccagtgctacccttggcctgaggtggaatcttagaaagtcgcttttaaaaagacacctggctatccagggcccagccactgagtgagaccgggctgcgagggaggccacagtggggagtggctcccgtggctccgtctcggggaggggcgctgcagcctggcggatgccgctgagcctgctcccctgctgtagtacgaagaggatgaactgagcctcgagctgctggccttggcctccccccagcctgcgggtgacggcgcctcggaggcggggtgagggtctctgccccccgggaccccaccgcgtgcacatcttactgctctggattccgctgccgggatgggaggggggaaaccctttctttctgtcctgtgagtcctgagaccagaggctcgaggggcccctaaaggatttttgttccttgtttccttaaagcacgtccctcgttccagccacggcagagccccctgcagagacccccgcagagatcgtggatggcggcgtcccccaagcacagctggcgggctctgactcggacctggacaggtaggggctctgccaccccagtgggcagcgtgcaggaggccgggaggcgaacccctcacactccaagctgcggccccgtggggggctccctgcctgctccgtgcttcttctctttcgtcctcatgtgagggcccgcagctcccagctccaccgtaggcgcaggggccgaggcgtgagctccgcatcttggggaggagagaggggctggctctgccgttgggcacttcctgtcacaggccatgggctgctcatgtctgctttgctctcccacagcgatgatgagtttgtcccctacgacatgtcgggggacagagagctgaagagcagcaaggctcctgcctacgtccgggactgcgtggaaggtgggcacgggcccctggagggccttgctgggctgggcatgggtcccgctcacagcctggttctgcctcaaggggccaccgggaagccctgggcccggggtgccgcccgtgctgctggctctcatgggttcagggtcagggctgaggctgaccgaggcctctctgggttctgtgcagccctgaccacgtctgaggacatagagcgctgggaggcagccctgcgggcccttgagggcctggtctacaggagccccacagccactcgggaggtgagtggggggcgggagtgggtggggaggcccaagatggtagctccctcaatgccatctgtgtcctggccactgagggtgacatatggctcccgtgtgtgacagggctgctgcctctcccggggggcctgcggcctggggcctctgctggggtgggtggctccggccctgtgagcctcggtgaggcctcggcgggcagctgggtccgacaggtttcccagccctaacccctgcgtgcaggtgagcgtggagctggccaaggtgcttctgcatctggaggagaagacctgtgtggtgggatttgcagggctgcgccagagagccctggtggccgtcacggtcacagacccggccccggtgagttcccgcacccgtggccctggccagtgcaggcacagcgggaagcactgggagctgcggtgcctgagtctcggtcctgtgctggagctggctgtgaggtgcccggaggtcgccccgggtggccctcaggtcccggaccacagcagcctctcccctgtgtcctcaggtggccgactatctgacctcacagttctatgccctcaactacagcctccggcagcgcatggacatcctggatgtaagtgcctcctgggcctcagtccccctggtctggcccaagctgccctaaggtggggctgccaaaacctgggtctccttgttgctgggccccaagggctcgtgcaggcctgtccactgccttcgtgagtgtgtgacccggcaggactcagcagtgggggagtcagggctcccggggcagagagttttgtttgtttaaaataacagctttactgatataattcacacgccataaaattcaccgctttagggtaaaatgtgtgctgcgcaggtgagggaatattatttagcaatgaaaaagaaaaatttgaatcccagcactggaaggctgaggcgggaggatcgctggagcccaggagttcgagacccgcttgggcaccacaatgagactccatctttattagccaagtgtggtggtgggcgactgtggtcccagttactcgggaggctggggtgggaggatccctcgaacccaggaggtggaggccgcagtggagctgtttgcaccaccgcactcccgtgtgggtgagagagggagacactgtctcaaagataattcgactctgatacgcactgccacacgatgagccttgagaacatttagttaaagcagccccagggcctgtatatcgttcgatttcacttaagcgagccgtccggaggagctagttcacggagagcggacggggctgccggggcttggggaggggatgtggagtgagggtttcacggggacagtttcagcttgggaaggcaaaagagttctggcgagggcggaggtgatggttgcccatcatgaacgtacttattaatgccacggaactgtacacttaaagatggggaaaacgggctgggcgcggcggctcatgcctgtcatcccagtgctgtgggagaccaaagtgggaggattgctcaagcccaggagtttgagatcaacctggtcaacatagcaagaccctgtcatctccaccagaagaaaattagctgggagtggggcgcctgtggtccctgctactcttgaggctgaggcaggaggatggcttgagcccagaggttgaggctgtcgtgagccgtgatggcaccactgccctgcagcctgggcaatagagcaagactctgtctctttaaaaaaaaaaaaaaaaaaaaaaagcagccggccacggcggctcacacctgtaatcccagcactttgggaggctaagccgggcggatcatgaggtcaggagttcaagaccagcctcgccaacatggtgaaaccctgtttctactaaaaacacaaaaaattagctgggcatggtggtgcatgcctgtagtcccagttacgtgggaggctgaggcaggagaattgcttggacctgggaggcggaggttgtggtgagtcaagatggcgccactgcactccagactgggcgacagagcgagactccatctcaaaaaaaaaaaaaaaaaaaaaagggaggggaggggttaacgtggtaaatcttgtatatattttaccacaataaagcaaaaaagactgagaacatgagaacaactcaccgtaactggtcttttttttttttttttttttttttgagacagagtctcgctctgtcgcccaggctggagtgcagtggcgcgatcttgactcactgcaagctccccctcccgggttcacgccattctcctgcctcagcctcccgagtagctgggactacaggcgcccgccaccacgcccggctaattttgtgtatttttagtagagacggggtttcactgtgttagccaggatggtctcaatctcctgacctcgtgatccgcccgcctcagccgtaactggttctaaggtgcacacttgggtggcgttcggaacatccacagtgtcacgcagccgcctctgtctagtcccagagcgtccttatcaccccagagggaaaccccatccctgtcagcagtcgccccgaccctcccagcctgggagcctccggtctggcgctggcctgttgagaaggtgtcctagagatggaggcgcacatgggtccttggtgccttctctgcaatgttctgaggtccccccgcccgtggcacgtgccgctgcagcgttgcttttgctgtgaggccgacttcctgggataagggcatgtggctctggcgtggcgggactgcgtggctttaggatgaggctgcgctcggccctgggcgtgttctcatctcctggagcacggtgcccaccttccccaccttcccgcctaccaaggcgcggttgctgtgagctacggggaagtgacttttctccttgttcccagaacacaccttctcccaggctgggcgggcccccgggcccgtttctggggctttggctgacttgactcttgggaaatgttcttccctggagcagtggcgacggccctgggcctgtctccctccaggtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaaggttagtggcgcctggtcagctcctcacgggcatggggaccgtgggtgggtgggaagggcggtcagacacctccaggcgctgtctgcagcgaggggcggccacattcgctggggatggtgcctttgccgggattcctgaaaggcagggtccatggtttgcaccgaggaactggattttggctgtaggagacccagactgggcttggggacatgataagtgacaggtgtcctggtggtgctctgtcctcagagcccatctaggccaggggtggtgttgctccacctgaggatgtttaggggcgtctggagatgtttttggttgtcactaggggtgggttggaggccacggaggcatcctgcagtgcccagggcggcctccccaggacgctcctccagccttgaatgtcctgcctgcaagttcgggaacgcctggtctgctgtccaggcattggccgcggagcctgagtcccgtcaccaaccccatggggcctgggagctgggcggggccggaagagtagcccggggaggcaaggcgaggctgaggtccacgctgctttgtgggatcctctcgggctaggggtgccgtgcccgctgcccaagcctgcacctccgtgatcgctgtagttgtgtctggcagggtggcccgaggcagggcccggcaggcagccccagcagattcaactccgtggccggccacttcttcttccccctccttcagcgctttgacaggtgagtgggttttccgtgggcctgtggacttgggggacagggaccctggacgtaccactgtggccaagaagttcgggctgggatctgagtgggtttgggtgtgaacagggtcgtgctttgctgtggctttttgtaagcctgtgttaaatggcagggagcgtcccgcaagattcctctgtggttgagctttgccatgaggcaccaggcatctgctccgatgctgggcttgtggcatggccggcagtgccgcccgcacgtgcccgacgccatcacctgctgggccctgctcgcctcctcctgcctcagccggcgctgcactggccccacgttcagggcgtgaggctctcgagatggcagagaagtgtggggcctgggttgtgctgcagcaggggtgggggtctcggcgttgggaactcctggcccaggtggacttgtgccagacagccctgcagggggagtaggcacccggaaatgtctgctcctacgatctcggtgcaggcaaggcggtgggcacgggaggaggggctgtgtggggctccctcggtctcccacggtggcccaggaggttggggacctggccctgaggcacccgctgcaccttgggctccatcctgtgctctaggcctctggtgaccttcgacctcttgggagaagaccagctggttctcggaaggctggcgcacaccttaggggccctgatgtgcctggctgttaacaccacggtgagccgggagaggtcgccgggcgccggcctgtgctaaccatggatcaggagcgctcctcagcctcacctgcgcccagggatgggtgtctgagggaggggctgcctgtgtgggcccccgggcagcgggagcatcccctcggctgtcaggcaggccctgtccctgctgctgcccagcagcggaagccgcccatgggtgctgggatgtggggacggcgtcgggaccccactgactgtccctctgctggtgtccaggtggctgtggccatgggcaaggccctgctggaattcgtgtgggcccttcgcttccacatcgatgcgtgagtggcctgtggggctgggccaggccaggggtgcaggcagacacaggggtcttattgtgggggccccgtggagcctcgaggtggctgacaggcagcctggcctggtacttcccaaataggaagtgtgccaggcagggccgcagcgtgggtggtctgccacactgaggggagtgggaggtctggggtgtggtccctgccgagctcagcccccgccttcttgccggcagctacgtgcgccaggggctgttgtcggccgtctcctccgtcctgctcagcctgcctgctgcgcgcctgctggaggacctgatggacgagctgctggaagcccggtcctggctggcgggtgagtgtcggcctgcggtgtgtgtgtgagatgtgtgtcggcccggggtgtgtgtgtatgtgtgtgtgtgtgtgtgagagatgtgtcggcccggggtgtgtgtgtgtgtgtgtgtgatgtgtgttggcccggggtgtgtgtgtgtgtgtgtgtgtgtgtgtgtgtgtgtgtgtgtgtgatgtgtgtcggcccggggtgtgtgtgtgtgtgtgggtgtgtgtgttgcagctcctgcaggccaggctgccatgactccttgggacccacacaggcagagtgtgcaggccggaggtgcagccaccccagcactggccgtttccctcctttggtcctgatcctagaccctgttggggtccctctgtgaccccgcccacccgcctccctgggcccctccggccggtgcagtcctggcaactttttgtttgtttgttttttagacagagtcttgctctgtcgcccaggctggagtgccgtggcacaatcttggctcactgcgacctccgcctcctgggttcaagcaattctcccgcctcagcctcctgagtagctgggattacaggtgcccaccactgcgcccagccaatttttgtatttttagtagagatgggatttcaccatgttggtcaggatggtctcaatctcctgacctcgtgatccacccgcctcagcctcccaaagtgctgggattacaggcgtgagccaccgcgcccggccagtcccagcaccttttgttgtttgctggcctttgtggtccagtggttggtttgtggggcccttaaggtggcttcatggataccgcctcggtttccacgtttgtcaggagggtcccgggtgatacgggtccttcccagggacttgtgctcagacctctgtgctggggggcgctgggggatgcttttggtgaggtcacctttcctttcccgtggggctgggctgtgtgcctcttctgccccagccatctcccctctccccacctgggcgcagtgccagcctgctgggtgtgaacgggtgtttcccatggggagtggagccaacgagtccccggggacgggctgaagagcagggcacggtaccgatggacacgggaagggcaggcccagctctgccctgtcccttcccaggacctgtgctcagggtggccgtgaatgtcttcccacggagcagctggagggtcctgggcccaaagcgtggggagtgctgtgctgggctttgcttctttcaaggggggtgaggccccccagacaccagacccttggagctgctgcccaacccctcctcagcatgctgtcgcccactcgccctgcctggaggaggagaggttcccctttggccagtggagccactgatggggctgggtgggcgggcacattccctgcagttcctggcccacctccttccccagagactcggtacctgcgacgtcatcatctgggggccttgggggcctgaagcaccaggaggagcaggggggccctgtccctcagccgatccctttccactcggctggcggggtcccgacagggtgttctcctttcacaggcacctcccacaagggtctacaggtgcctcctcaccctgcgattctagcccaatctggggaggagctgtggccagcagagcccccccaaggctccccggggccccaggctgcaggaggccttggtgagggtcccagcactgcgggcagccaagagctctggcagtgtgcggtcccagacacccaagaggcctccccacaggcgggtggcacgcccaccacccggattcctacggtcttccacctccgaccacagcccttgtctgccgtccagcaaggagcaggccctgctggtgttcccgggttccccggttgtgcgccccaccccaggcccctttcccatggctgcctgtcccgcggctcagggcagccctccatgtacagtgctgcctgcacagagcctgtggcatgcaggccccaaggccgtggggagagtccggggtcactgcagacccgagccccctttcttccatggagtcaggcctggcggggctggttcaggcagactgaagacaggaggagggagaatacgccctccacgctgcctcagctttgcttgtcactctcgtctggcagacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaattacaggagtgttggtggccggtgggcagagcctagcagggggtgcagccgccaaggcccgggtgtcccagctgttgctcaggagccgtgggccctgcaggagtatggggaggatatgatgtgtggggagcaggggggcaggtgccccagccctccagctgcagcttcctgaggttctagaagtttctcaggctttacaatgtgtagttgggagaatacgatggaagggtgaacccgactcccttcaaaggaatgaatccaaaaatctagtggagctgccgggcacccagaggcaggtgggacagagcaaggtgcagacgggtcacaccctccgccggcccgggccgctgcgttctcgcccagctctgtcgcgtattccaacacagacatgttttttcccagcaaaaatgctggctttgccacagctgacaaaaaaattccagaagatgcctttctgcagcagcacgctggtcctggggcccaggcccctcaggggtcgtcatctgcctcttccaccacctcctcgtccagctccctggcgtcctccatgctgttgtggcggacctgctcggggacggtgcgtggcagtgggagacccagcccccggtgcacggcgtccacggcctgcgggctcacgtagtaggacatgttggccaagggaagccgccgccgcatctcctccaggaatctgtaggcctggggcagaggagcagacattactcagctttcctgaacaaccaggcacgaccctctgcctgcaggccaggcacgtgctgctgcccctggaggcgggtgggggtgcctccgcgctggaggacacggggtgcactgaggcttcccattggtgatgggggaatgtggtgatgaggggatgcggtgcccgcggaccgcacacatgccatgtgtggacactcaacaggaagcttcggtcagcatttcagctggaaatgcagagccagggccctggaaagtccctcagcagctgtgcacaggcctgctcaccgtgcgtgtgcgggcagagcctcctggggaggcagaggccccgcgttctgcactcgagtcttgcgggtggacatgcatatgtcagagtggagggcaggcagcgatatctactggtttggcttgggtattttttttttttgagatggagtctcagctatgaagatataataagcttgttggatggcccctcccatcacctggcagtggacctgcgtttaaggaaggcctcagctggggtgggcgctggtggagtgcaagccttccacacagtctcaaacgagaggctgagggcaaacatccacacctgaaaagatgctgccttacatgctgacaaaccac

SEQ ID NO: 13262 - DNA, 303 bp, Homo sapiens
tttttttttttgaaacagggtcttgctctgttgtccaggctggagtgcagtggcagtgaacatggctcactgcagcctcaacctcccgggctcaagccatcctcccacctcagcctcctgagtagctgggatcacaggctcatgacaccgtgcctggctaatttttaaattttttgtagagacagggtctcactatttttcccattcttgaacttctgggtgcaaacgattctcccacctcagcttcccagtgctggaattaccggcgtgagccaccgggcccggcctctgccagtttttctg

SEQ ID NO: 13263 - DNA, 126 bp, Homo sapiens
ccgggcgcggtggctcacgcctgtaatcccagcactttgggaggccgaggtgggcggatcacgaggtcaggagatcaagaccatcctggctaacacggtgaaaccccgtctctactaaaaaataaa

SEQ ID NO: 13264 - DNA, 9945 bp, Homo sapiens
ccaccagacaatgaggatgaagatgaagatgtcaaagctgaaagactaaaggtcaaagagctgatgggttgccagtgttgtgaggaggtaatttattctttatggctaagtcatagtaaatatgaaatgatcaattcccggtatatagaaattaatctgaaaaatatttttctttgcatatgaagcaatctgaaaaaaatctttcttggaaaaaaatacttcgtttacttacttttgaataagccagaatttcagtcataaatggatatttatttgtacagtatccccttattagccaatataatttttgtaatatggatatgaggtatgtgcagcctgtcatttcatgataagttttataactttctttttaaatacaatttttcttattagaaaccatccattatggtcagcaatttgcataaagaatatgatgacaagaaagattttcttctttcaagaaaagtaaagaaagtggcaactaaatacatctctttctgtgtgaaaaaaggctggtatttaatttttccttacataacttttctagaagagtaatttctacttttagtatgatttgattatgatttttttttctttcaattcctttaggagagatcttaggactattgggtccaaatggtgctggcaaaagcacaattattaatattctggttggtgatattgaaccaacttcaggccaggtatgatatataagagtataggatatgttgaatgtgatttatattgttaattaacataaacttttagtgacaaattcggattttatattcaatttttatgtatatttttagaattttttgtacagcctgatcaaattatgatcttttgggttatctgtaaaaataatgtgcatggtgaaattttcatagacacatgtagacacacgcatatacagtatttctgcttttgtaatgcttacatgcgtgagttatttgtctaccaacttaatggaagacagttttattagcttcaggagatatgggagcttgttttgacctgccatcagctagtcttttattataagcatgtcactgaccactttgtggatacttcacaaaactaccctgatcccatttcctgcttctctccccttgcttactttatgccagccacactaactcattgctttcctggaaaatgccaggcatactcttttctttgggtttttgcccaagatgttttctttgtttggctataccttataccctagaaatacatatactaaattcacttacctctttggctcaaatgtcaccttccagtgaagctccctgatcattagaattacatcttgctttttcatccaactctgtattaccctttctgaccaagtctctgaactctgacttagctttatatgtccttccatcatcaaacatcaaaaaggagtaaaacatctgggcgggtgcagtggctcattcctgtaatcccagcactttgggaggctgaggcaggaggatcacttgagctcaggaattcaagactagcctgggcaacgtagtgagacatcttccctcctaaaattcaaaaaagaaaaaagcaatagccaggcatggtggcacatgtttgtagtctcagttacttagtgataataataataatgacaataaaggagtacaaatctgacttgatattagtctggctgtaggaaggggttttaattaatgtacttgccacttccttcacagtgtaaattaagcaaaataataaaaattggtttgtgtttctataggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcggtaaaataattgtctttagattccttttgttacttagaggaaaggtttgcatttcatatttttaaaatttcataacaagcatttctgtggacaatgatttttatagaaaatgtttattactttttcatatattctttatgatatatgaaaatatactgatagctgtaaattatgatagttataaaaaggtcattttttaatttctagttacaggataaatatacctatagatatcatgaaacttattttaattcaaagtgaaccattttatcaagatattaatttatttaaaatgatgtaaattggagacttttgcccttacctacttataataagcttcgactaagtaactattctagagaaaacaacatcagggatcacacccagttggtatttgtgtttatatatatcatggtattctcattttgtattgttcattttgcagaataacacatgcacttgatttaaaagaacatcttcagaagactgtaaagaaactacctgcaggaatcaaacgaaaggtactttcattaaacaccaaataatgcctgtatttttattgatagtttagtacctgatattgtcttgatagattccttatagtgaacctttgttaatttcccacccatctttttctttccatgtagttgtgttttgctctaagtatgctagggaatcctcagattactttgctagatgaaccatctacaggtatggatcccaaagccaaacagcacatgtggtgagtatggtacttgtgacacagtacatgatactttagaatagaacagtttcttttattataatagtttaatgttagttatatgtacatcttgattttaaatcctattcaaacgatacactagtaattaaaaattaaatagatttagagatttccttaagcttttaaaactttgcatatttttcatgaagtgttcataatattttacatattccgaaacagaaataagcatgagtcattattaagataaagagttctagtgttctgaatagtttttaagtttttttctagtcatttagcatacaaatgatcttttccataataatagtgtcttaaatttatgttgagactctttctaggacagtcatgcattgcctaatgacagagatacattctgagaaaggtgatgttgtcgttgtgcaaacataatagagtgtacttatataaatctctgggtggttatagcctactacacacctagactatatggtatagcctattactcctaggctataaatctgtagagcatgtcactgcactgaatactgtaggcagttgtaacacaatggtatttgtgtatctagatgtatctaaacacagaaaagatacattataaaagtattataatcttatggaatcactgttggaaatgtgtttcatcattgactgaaatgtcattatgcagtgcctgtaaagtactaattagttgaacaactctttttttttttttttttttgagtcagagtcttgttctgttgaccaagctggagtgcagtggtgccgtcttggcttactgcaacctctgcttcccaggctgaagcgattctcctgcctcagccttccaagtacctgggactacaggcaagagccaccaagcccggctaattttttgtatttttggtagagacagggtttcaccatgttggccaggctggtcccgaactccagacctcaggtgatccgcccccttcggcctcccaaactgctgggattacaggtgtgaggcacagtgcctggccttgaacaactctttaagcctcaacttccatgtctataaaatgtaaggtttggtttggatgcatgttacggttttcttatgattcaaagcctgttttggttataacatgaaaaggcatcaattttaaaatttatttgttgtcatacttttagcccatattaacatttgaaatcatagattttttttttccatttgacaagctttcaaaatgaagggaaaataaattagaatataaaagtcatggcctggcgcagtggctcacgcctgtaatcccagcactttgggaggctgaggcagcagaccacgaggtcaggagatcgagaccatcctggctaacacggtgaaaccccgtctctattaaaaatacaaaaaaaaattagccgggtgtggtggcaggcacctgtagtcccagctactcaggaggctgaggtaggagaatggtgtgaacctgggaggtggagcttgcagtgagccgagatcgggccacttctctccagcctgggggacagagcgagactccgtctcaaaaaaaaaaaaatcatagttgggcaggatgtaatagccatagcaattgatatttggtaagttttaattaacttaattaaccaaccggttggatttttaaaaacccatttttttttaacaaacagatgtgttcctctctttttgttttatttatgttttataggcgagcaattcgaactgcatttaaaaacagaaagcgggctgctattctgaccactcactatatggaggaggcagaggctgtctgtgatcgagtagctatcatggtgtctgggcagttaaggttgatgtctaaatagcgtgccattcaggggaagaggttgggggttggattttgaaagtcatcatttcaaaaacatggcaatagttagtaatttaaatgttaaatattttagtttttgagttagcttttgatagattgacttggaagtatgttgagttttttaaaaatatggctgtctactttgaatttgaattcacttaatatttcaataacttggaatattatttttaggcatagtacttgttatttcaaaaaattgttatatattggattaattatgtaacacaaatatgaaataaacatatgagtttctacttacataaataaataattgagtaaagaaatgtgtcagagaagaggtacatcttccttacagaacaattccaaataataatatatgtagataatacccacttcaagggaggaggcttaatctcctatcccccaagtttggacgggacttagccagtttcttgtaaaaaatgaacgacagaaggagaaaaatagtaactttacagttgagaaagctggcaaatactaccttaactaaacgatgttgtgcagatatcatgtattcactgatatgatatgatggaaaaagtactacagctgtgtaatattctctccaaaacccataacccaagtgtagtcatgagaaaaatatcagactaacccaaattgagggaccttctaacacacacctgaccagtacttctcaaaactgtcaaaatcatgaaaaagacagaaagagtaagaaactgtcacccacagttagagactaaggtgacgtgacagccaagaacactacggtatcctggatagaacctggaataaacaaaggacactaatagaaaattggtgaaatctaaataaagtatggagttcagtgacaaggaatgtaccaatgtcggtgtctcagttgtgaggaatttaccatggtaatataagatgataagattagggaaactgaaaccggataaagagtgtatggggatgctgtattttctttgtaatttttctctaaatataaaggtatatttttttaaaatgtagttatatgtgtgagagattattctttgaagctgtcattttatatctgagctttcttttaaaaaattacttcagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaaggtaaaattttaaagaatgtggttatatttctttatagagcaaaggttataaaaagttattatattaaggattaagtgaaaaatcatcttttcattcatagaccatatatatatatatctctgtgtgtgaatatatatgtatattttttcatatatatgaaatatatgtatctgtagatagataatttatatatctctctctgtattatcaccaatactggactaatgaagtctgatggctggtgttttatatctgccttagtattagatttttcaatattcagtagtatttaaatttttttaacattcttagtagtaatgagagttgttttgcatgaaaatgttattattttaaacaattttcatccaactaaataccaaaataagttattgaatttaattttgaattttaaacatgttgaactttagctttagaacataatagtagtaatttttaatttttttccatattttatctttttttccagtttttcttctattttggcttataaaattcctaaggaagatgttcagtccctttcacaatctttttttaagctggaagaaggtaagtagtatcttctattttggcttataaaattcctaaggaagatgttcagtccctttcacaatctttttttaagctggaagaaggtaagtagttgaaaagcacttatgttgtagctctcaaattatgaaagaattttatttaaaaagtttaaaactggggactcggtttattttagaaactatggcagataagaagataaccttttattcatttaatctaagacacaggtaaacactaatgtcatagggattttgtagataaactctattgtaatgtaaaccttttacaatttttagagagcattgacacagtttatcacattgcatctatgagaagggtcagcttaattatcgagtctttgcagttagtccagcagcaagagctctgagtttcttgaatccttacttcatactggtccatagaagtagcaacactatcaagactccagtggcaaagagaattctgagtgtagcgaggggtgggcagtccccaaaattttaaggaagcttatagaatcttggcatttaaaaaataagtggtatgtaggataaatatatatatgctggtgacagttgagggagatcacctcctggaagaatcaggtattcatatgcagattattttatggcatttataaactgtgaaacaacctatatttatgtataaggtttattattaataattttcaaaataactacaggatttttatgattgttctttatgtgattactgaatacaaaaagatttcctgatactgtatatattcttgttgcagctatggattaatgggtttacttttgccaagaacactaattaattattttttggtctgtaatatatggcctgcatgatgttcattgtttattcatgtttattggccggcatggtggttcacacctataatctcagcactttgggaggctgaggcgggaggatcccttaagcccatggttcaagaccagcctgagcaacatagtgagactctgtttttacaaaatattttttaaaattacccgggtatagtggcatgtgcctgtagtcccagctaactcaggaggctgaggtgggaagattgtttgagcctgggaggtcgaggctgcagtgaaccatgattgtatacttgctgtgttgcccaggccactgtataccagcctgggcaacagagcaagaccttgtcttaaaaacaaaacaaaacaaaacaaaaggtttatggagataggaccaatatccagaatctagttcaagaagccagaataggctacagtggagttggagaatgggagataagagagcagggatcaaaagaagacatgaaaagaatcaccaggaaaaagataatggaggagaacttagaaaaagtgaaataagacaagtaacattcaacatacagtacttagggctatagaggaattataggtgtggggaagagaaaggaagtaagcgggaaaaataacatgttttggcagcttcaaatttaagtgggttgattacagagatattttaaaacattgttagccactttggtaggtattgccatttttttcagatattgataagtaaaatactatttttatattttaatagctaaacatgcttttgccattgaagaatatagcttttctcaagcaacattggaacaggtactataaagttaaatttttaaaaattattttatagaagaaagtatctgatatcgattgttttggtttatattagagagggagagatatcgtaaaccagtgacaaattggtacagaatgatcttaaacttggtataattttaatcaaccttaggttcttcacttactaattttttaaattttattttttaaattgatattattttaaattgacaaatcacactgtttattgggtacagtgatgttttgatacatgtgtgcaatatggaatgcttaaatcaagctaactttcatttgctgattttgaatatctgtttttttcattttgtaaagaaagtgagtcatgatggtggtgtttcacattagtgtatttgaaattacattgtttaagtagttatgaattattttttaaaaaacatatctattaatctaaaatagtattcatctttgcatgtaacttttgaaaataatctgtttgaataatgttaatgttaataaatctcttgatacttgttgatataactagatatagccttgtaccatttctgatttagttaaaagttctttgaggtacttgagatacagcatactgtattcatttatttcttttcacctaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtatttgtttttattggtaaactttagtgaatctcttctataaaattgtaagtagatcagtgtgtagatttatttagtaacttacctcattgactttggaacatggtaggatatgaataaactctttcaagggttaaattaagaattgtaagtgcagtgcgcctatttctttttaataagaaccagaatttcatttttgatagagttaaaggcatggctaatattttcttagaaatacttccttgtacaacccatgtattggctcaaggtataaaatagtgtaaataatgctagttgacattacatttcaaccaaatgaaagtattaacttcataaaacaaatatattgagagt

SEQ ID NO: 13265 - DNA, 416 bp, Homo sapiens
ctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcaggtaaaagtttaattattttttatttataatatatgtaagcaattctcaatgctgctctttaagaaaaataaatatgattatattaataataagctttaagagttgaaaatttaagacaagtcattttgtatactgaagtgaattctttgttatttagtgctgataattgaataatgagtagctcatattaaaaatgatgcaaaaacctggcact

SEQ ID NO: 13266 - DNA, 139 bp, Homo sapiens
ttgaggccaggagtttgagaccagcctgggcaacatggtgaaaccctgtctctactaaaaatacaaaaatgagccgggcatggtggcgcgtgcctgtaatcccagctactcaggaggctgaggcaggagaatcgcttga

SEQ ID NO: 13267 - DNA, 1942 bp, Homo sapiens
gcaatgttgtggtctcggctgactgcaacctccacctcccagattcaagcgattctcctgtctcagcctccacagtagctgggattttttttttttttttttgtatttttagtagagatggggttttaccatgttgcccaggccggtcttgaattcctgtcctcaggtgattcatttgcctcggcctcccaaagtgctaggattacaggcgtgagccactgcacccagcccaaatgagatgtttctaaatctaaagtttcttctgcttctgcatttctgtgaatctcatttgaaatttttcagggaagggattttatcatttgttcagagatgtctttatttttattaatacccataaaacgtttgtgtatttgcttcttcctctttctccttttgatcacattttagctacttatctagaggatctctggccaagtattcccttttattgtattgataacaattcttaatggctggcctctcttgtgtacaatgagccaatattcttttttgttctatatttttgtatcttcccctttcctgaacaaagcatatttagagtctcaaagaaatcctctccacaaagacatgttcctccctctggtgtgggtagacatagggtaagagtttggatgaaacttttgtaaattgtagtgttcttggcataaatatgaattaaatctttttttatatttaaataactagttaaatatgtgcttcttactaagattaggtattttttgccaagataacaatgataaaaacattttgggggggaaattgaccttaaaattttgggataattcaagaaatgtctgcagaaaattgatttatgatcttaatttttgtgttagtcctttgaggtttttttgtttttgtttttgttctttgtaaagcgccttatctgttttggacaagtccaaagtaaatggttgggctcttatatctgttttacccttatttttcccattaagtaatggtttaagaatatatcaagcaccttaatttgttgttaagtagctagtgcttacaggattccattaaattcactttaataagcctatgaagttcttatgaaaaacccatatctgcgatatgtttgatttgtttctttgttttaattcagtgtttaaccctaggtatgctacatacccataaataagataccatggtaagagatagtatgttatagtgggaaaagcacaagtttttagatagagatcaattctgctatctacccttacattgtaacctttctgacagggctgctgcggtgcacaacttcgggagccatcacttatttttgttgtgttccagaaggtgtcattttcatagactgcagtgtgaatagtgtcctccattaataatgcaatgatggccttgctctctgagcctcagttttatctataaaatggtacctagaagagtcatgatttcttagaatcccctaaattattaaggtgaaggtagaagatgattaaagcgtgttatctcctaagctatggcttagattttccgaagctcatggttctaggcacagaaagtctccattctacactgcatttcaacctgtgttgaacaacactccagttcagcctgtattgctatgccacatagagtttgcctgaattattatagctttcttaatagttttgtttatgatccactctctccagcccattacacaggagccagctacctaaatttcctatctgagcatgtccttacatttacttccagcatactattcatttgccatagtagagtattaagattatttgattttctttttactttctcgtagtgcccaatgtgtagtttactcaacatcataatatgtaatgtttttcaactacttactgttgaatacaaagttatctcatttaattctcagtctgatgcggcagatattataatccctatctttttttttttttttttt

SEQ ID NO: 13268 - DNA, 825 bp, Homo sapiens
tctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttat

SEQ ID NO: 13269 - DNA, 7695 bp, Homo sapiens
caggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaataggtagagtatatttctttgtggggttttttttgttttttgttttttgtttttttttgagacggagtctcactctgttgcccaggccagagtgcagtggtgcattctcagctcactgcaacctccacctccggggttcaagcaattctcctgcctcagcctcctaagtagctggaaagttctgggattacaggcgtgagccactgtgcctggctggtagagtctatttcaataaacatgatgcttagacaaactttccaagatattcatgcctgcaggggtatcctagaagtaggtggtattctttgcctacctgcagttaattatgtagacatctgcttgattgagtgggagactgtgactgacatccatgtatctaggcgcctgcagcaggaaaatgccaaacacagcatgcttctgatgttgtatgtgtgctttcctgcatggaggctgtcatccaaagtggagggtgcacaagacgctcagcttataaggatgggctgcatgtgttggtcattcagtcagcaaatactcagttaaatacccctgggtgcctagcactgtacttggcaaaaaggacataagggtaaacaaattgaagtcctcaaggagtttgcaatctggtgggaagatggataagaaataaagcgatgataatagaatgaattattttacagggattgagggggtaggttttagaagattgcgagttggtgatggttgctattctaatttatgcttaatgtcatgggtcattggaagtaatattgtatatgaaaagttagttccagtccattggagcagctttactcatttctcagtatagataatgaattttaatcctttaatcagtctgattacaagctaaaaattttaaaatatatttttagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggtgagtcttcacactgttactaaattgaaaaaggaatgtgaggccgggcgtggtggctcacgcctataatcccagcactttggcgggtggatcataaggtcaggagttcaagaccagcttggccaacatggtgaaactccatctctactaaaaatacaaaaattaggcgtggtggcaggcacctgtaattccagctactcgggaggctgaggcacataattgcttgaacccgggaggtggaggttgtagtgagccaagatcgaaccactgcactccagcctgggcgacagagcgagactccgtctcaaaaaagaaaagaaaaaaggagtgtgagcagattaaaatcaaacagaattcagaattcagccaggcactgtagctcatgcctgtaatcccagcactttgggaggccaaggcgggcagaacacttgaggtcaggcgttgtggcaggtgcctataatcccagctgcttgggaagctgaggcaggagagtcgcttgaacctggaaggcagaggctgcagtgagccaagatcacgccactgcactccagcctaggtgacacagcaagacttcatctcaaaaaatgaaaagaaagcagcttaagaccagttttgcaaaaccatttttgagatttagtaactgcccaaatcctaattccctttcattacttggaaattaaatctttaaaaatcaaaatttggttccctgtaaaaataaaatagttggtagaactttcttgatgtttgaaaggttgaaaggattctcccgttttataaacagtactaaattagtagataaatgggttggttggaactctcagctcatttctctattgaaacactgtggtgggtagtttcctacaccagtcagcagaagctcatataatccataaagcagctaaactaaaggtctaatgttctgagttttgtgaatttgagaccactggaaacatttcttcccttttgtgtgtatgtgtttttttttttttctttttttgagacaaagtgtcactctatcgcccaggctagagtgcagtggcacaatcttggctcactgtgacctctgcctcacgggttcaggccattctcctgcctcagccttccgagtagctgggattacaggcatgcaccaccatgccaggctaatttttgtatttttagtagagacgggttttcaccatgttggccaggctggtcttgaactcctgaccttaagtgatccacctgtctcggcctcccaaagtgctgggattacaggcatgggccgtgacgcctagccccaccctttggtttttataccagttatttccaggtcctcttctagccctaggtaaaatgaaatgggtgggtttccttgccttcctttccatgtccctcttactgggctctggggccctcatgttactgtaaaggacccgatcatactctccagtcataatacctagcttcagttcagggctcccgaaagtataccctgtatagaatgccctgcctcttcaaaatctaattttcagagaaaaaaaaaatctgggtagatgaattcaaactaatgtgtaaaacaaagtattttccatgacacggtttcatccagcagtccttggtatttattgttcattccctccttccatttttgaatctagagattgtctaaaaaatttcaagcattttcatagtggttccattctgtgaataatctttaaaggatactggtggtaatgagcagggcaataaattaggtgtttgtacgtcagagatccatagtaacccagtttggcctgcaaactatgaaattattacacaaatgtggagatttggctttaaatgtttgcatttaaaattgtaagcagtgagtagcaaaaatctaacctctagcattctaaaaccagaactcttaaataacctttccttatttcatcactgtccttatagaagttgatggtcacagtgatgatactaagacatgtcagaaatgcaaggcacattctcggcaaagagccatggttttgttcagttggtattgtgccataaagagcccttggcttgaaaggacccaagggctcaccgtgtggttttagccagatgttaattaagctggatggcacctaagatcccttctagtttaaacaggctatgattatagtttttataatcaatcaaattttcctttcctgtctttaaaaataaattcttcaaaatgaataatacctgtatgggtgtatatgaaagttctgggttaaatatgtgggttaaccattccttcaccactcctaataatagtcttaccatattcataattccttagaaaagtacttcctataaaaattggtcccttgtgtgtgaaaataataaatgaagcaatatatttgagaactgtgcttctcagctcttgtaatactcagcctccttaataaatattaatgttgttacctcgcctgcactccatcctcctctacattaggaaagacagtggttaagaactcttattagcctgggcaagatggtgagaccttatctctacaaaaatttaaaaagtagctgggtatggtggtgcacacttgtggtcccagctatacgagaggctgaggcaggaggatcacttgagcccaggaggtagaggctgcagtgaccgtgatcatgccactgcactccagcctgggtgacagagtgagaccctgtctcaaaatgaaacaaaaaaagaactcttattagccctcagacctctgtctgctacttctctaatcaatggtttctttttttaaagatgtaaaatagaataatagtatgttgttaaagattgctgaagagatagtaagatcatacctgttaagttagtgattataattctgtcattatcttgtactttcccagccacacacatttagttttattttctgtgagtttaatttaaataatttttttctaaaatatgatttattactaattcttttttaaactacacatgctttctccatccccctccccgccaccctcccttcccccggccattgagaatcacatctttccaagaaatagtccagcccctatggaagtctggtttttgttcttattgggtctataaaccttgagttgtgaagatacctgttgtttcatacatagtatgatgttttacatttctttgtaatatctgacaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggtttgt

SEQ ID NO: 13270 - DNA, 2804 bp, Homo sapiens
gttttttaaaagaaaaatgttaagactttattcaagatgtgtatcaggcattataacaaaacagcagaacttcaacctttggaatactgtaattttacatccctttgatgcacagtccagtatactattttattacagatcattctatagggactacagacatgaactagaggaaatgtgcacagtcaaaatccagaatatcagctctgggagtgtacactgttagaggatgaagcacatcctttgccatttcaaatactgtgccaggtggaggactaggaaggctcaaagatggtcatggttgacaagcactcttatcacaaacacatggatagcttatcacggagaacacatttcaaaggccagcaaagtgagcaagctattcacacaaagccaggagggattatgactaaactctccagtttataagcacaagtccacatctcacctcctcagaacaggtgctcaatggcaattaactaaaagttatgacatgaacattacagactttccagctagcattttgtaaacagcctgtgtctgtaagtcagcaaattaaaaacattcagttgtatcctctagacagaacaccacaccactacatgtacacttacaggctttcacattttatgtcagttcatacacaaatgtacaacttgtcagatacgtaaacacattttgccagaaatatgacagctgctttcagttgtacagtgagtgtctttaagagagaaaccgactccctagtcaacacttgaaggaaaaatagttacatttacattaagacagagtttggatacctttatatttttcaatcttgaatgagaagtaataatacagcatgtctgagaatagagcgcttcaaactttttttggcatagttaagtgcaaacttgataacctgtacttgtcacaactctccattgtaaaatggcgaaaatataggttgttcacgataggattttaaactgctgctaaaggcaatttattgtttcggcaaaaaaaaaaaaattgctaagaagctgtgtaagctttttttttttttttttttttttgcattcgtttctgataattctgggtacttccaactaacaggtaaatacattttaaagagtatattcttcttctgtctggaactactcaatgagcacaaagaaaacattttctgtcttccttaacagatttaggtattggtgggtgtggggcacagaacatgagcaaacagcttctgtttatcctctcagccacaaattcgcttttaggtatattttcctatacccttttgcaaattacaaaatcaccttcagaggaactatgggtagatgggattccaatatgcatatctggcaacaatcagcttcaaatcaaaccctttctggggtggctaagatccagctaatgtgtcatcagcaaaggcctctaatatgtgtttgcgtagtaatggaacagtttttaattgggcctgtttatagttgactgacagtaagttctatatggtatataacactaattctctagtcttctgggcatatctacgaacaaatacaatccaaatattatgagtaactgggttgtgaccactgcatgcattacactgaaagaaacaccaactcgaagcacaaatatattattcttatatttcggctcagctctcagtggggagagcagctacctcggaccacaatgccatttaaaccagattcttttcaaataaaattctcaatctaagtggaaagccccctcagagaatgccttattcccctactaagcaatccaggcttgtataaaacgtctgataaggcctgtagtgcccattgagtatgagtctgctgtttacattctgcacaggccaggaggggaacagaaggtgtgagccacaggtgctcctgggtctgaccagcaagtctaacccatgaagatctcgagctccaaaaccattctagagcccaccattttgattgttacacatgtgtttcagatgtatgttatggcatatctgaaacagcagagttctcagttttttgtgtgtttgtttttgctaagctaaacaagttttgctagagttcgctaaaacaaggtgctcagagtgtaagctcctctgtcaggaaatcggcagcactggtcacgataaaggagaaatcgtcctttgtcaagcacagaattactccttccagcagctctacatgttcccatcctcaagaaattgcaccaagagtgagctacctgcctatccctggaaaagattcagaagctcctaatccagaatccagggaggagatgagcttcctgtgactcttctcttttactgggatgttcccctgacctctcatcacactttactgtgttgtgaaatattgtttctcttagtttgtaacttgtctggtcttttgactaaacaactatctaaagaatatagaccacactcctgcagggaaagggatgtcttactggagttgtatttggaagctttataagcacatctgagacgttctctagaatcaaaatatttgtctatatttgtttttgcagttttcttacatatcagaacctctggcagcccttgcaagtccattatattaaaagccaaaagccataaatatgtacatcatagttcaaagtataagtaccaagaacaaagaaagttgtaaaaaatgctgtgtttgcatttacaggactaaaaactaagtatgcaacagataaattacaaatgtacatctcagcagcataggggtgattctcttatctttctaaaaaacacactgctgtctataatgacaatccaattgtggaaaattaccaacctc

SEQ ID NO: 13271 - DNA, 1206 bp, Homo sapiens
gtgtgagggagcaagagagaggggtgtgggagagaaaagttggaaaggagggagagagggagtgggagatgagtacaccatctgttttgctattttattcatctttccttcttatattcatcctttgggatgaaagactggggagtattgagaagaatattaaccatcaatttgtaacatacccttgatgcgttgaaagaataagccgctgctaccatagtgttatattggattgacaactatttattgacatttgctgtaccatttaggggataagcagagaagtatttgagaagaaagtattttgtaaaaactgataagaaatcttagtttgattccagtcattaacacttgagtccttaggcagagttaagataatgattataatactttagtcctcttcttgggatcaactgggcagggaaacattcttttaaaatgggagatgtgttgccaaggtactttgttacaaagttttgttgaaaaattttacaatgtaggaaaagtggtatatttttaattgtggaatttacaagacacagaactatggttatgtgtttctttgacttctgaagagtttctcaagttaataataattagacttgagaatgtaaacttcacattttacaagctaagctttagagatcaaagaatgatttaggtgaattacttgatatatccgtgttgacaacccatgaccatttatgcctatgtaagtataaatctgtgccacccaagtaaaatattataaattttatggtctattttagtcagagatttatgggtatgtttgtgtctgagttgttttctgagcataatacattgatatatcgtgagtttcctaacacatattaagttgactcacaatgtgttgttggtctgcagaactcatacatattttatatgagatgataccatcagtagacagtcttcgctctcttcatcctctatctataaattgttattaacaagaaaaattaagtttctccttttgtggccctaatatagttcaggcttaaaatcaacagcaaccatcctatatatttcttttaaatgaggaaactagagattgtacacattttatccacagagatcaaaaaaggttctgcttgctattaaccctaatggctttcagggaggaagcagcactctagcaagggaattagtattttaaaagtttctgttggggcaaaaaaaaaaaaagaa

SEQ ID NO: 13272 - DNA, 2072 bp, Homo sapiens
ctatagaaatgttttggtttcttttcctcctcctccttctccagaattggctttattaacagcaagaattcaagcagtctccctggtctctcatgcagttcaatccccgacagcctttcctgtaaatgccacctgctgtcacatgctccatccgggcctttgttgtcaggctcacttctttctacatcttcctccattgacttcagcagctccttcatgcatgccacagttttttctgaagtctttggatgcattttcataatgacaacatcaaagttcctgcttctctctgtgttaccaaatactttgttggagttgttgatctgacttgggactttgtaacattcactgaggcagacatgtattttagccatagttcaaatcctcctctctgggagctggccttgcacctctggaaaagaaccacatgttttgatcacagtggcttccaccaagagctggggaccactgacaaatggctggcccttcccccccaattctaaaggcctctgccagagctccagaagccgggcggagcctgccaacaaccattatcagcctgtccgagtagaccctatcttcttatttgaaaaaaaaccccactttctttagaaaagttagatatgtgaagatgctggtctacagggtccttttgaaaacatctaacatcttctatgggacgtttccacagttcaccacctgaaacacttggaccacacatgtttgcacatcctggactttctgtctgatacatctaggactgaacaatgggttctcccagaagttccagagggaattcctacaattctcgcttcaagatggcgctccagctgcatcacctgcaggcctgggctaggatatgtcttgactctccttatgacactgtcttggtggctcacttgggtgagtgtggggccaatccaagggaagttgcggggaagctcaaaaaggtaactcagtttttcttgggagaagagagattctgagcagattggaacgtaccatcaacagtgccttcttcctcctgagctgatatctgaatgagtccctattcacaggaagaccctggcccaccttgatgtcccactcaactgtaatccattggtcctttttgggcaatgactgagtcctctcctgaccaaggaaaggaatgcatctcaagcctctccccatcaggccttcattagccccatcccctacacccactgactctgctcccactcccgccactgtatcgcccagcgttgcttcctgcaggaaaccctgctgaggagtctagtggaggcagagatgccctgtgttgaacactccaccatgcattatgtcattttctccacacaacagccctgagaggaaggaagtgttattcccattttatagaagagaaaactgatgctcaaacaggttaaataatttctcaactattgactgaagagcatgggatacaagttctaggccattgtcggcaaagtctgtatgcttcacagcttggctgtgggatgtgctcctctgccttcaggagccaacccatcaccttggccaaccctttgaccagtgcaaacactgcatctttgtcagcctcctctgctagcacagccacccggccacctctataaccaatgccaacagctcttgcaagagcaggaaagactctccttagaccagagtgtcccatcctcagcactattggcattttgaacctgataactctttgtggtgatgaggtgttgtcctgtgcagtataggatgtttaacagcatccctagcctctagttgttctctggttgagaacaactgccctagggtactcatcctgtcagctctctctgcttttgagccaaagttcctgagaaagaaaggtctctgatgcaaagcctgtccccactatagcactttgaaacactactcttgctgggacaggcacctaaccaggctccctctcaccatctgtcttagtccagtccagctgctataaccatatccatgctggatagatgatacatgacagaaatttatttgcacacaattccggagcctggatgtacaagatcagggtgtcaggatgctcgagt

SEQ ID NO: 13273 - DNA, 2072 bp, Homo sapiens; identical to SEQ ID NO: 13272

SEQ ID NO: 13274 - DNA, 42 bp, Homo sapiens
ccagcctgggcaatagagcaagactccatctcaaaaaaacaa

SEQ ID NO: 13275 - DNA, 248 bp, Homo sapiens
ccagcattatgcttcctgtacagcctgcagaactgtgggccaattaaaccccttttctttataaattagccagtctcaggtatttctttatagccattcgagaacagcctaatacgccctccctttcatgaccccagagcctgcactcccaaatcctatgccatccaagggtgatgaccacctggataagaatgagcccttcactggaaaggactgtgtagaaacgaagcctgtactccccaacaagt

SEQ ID NO: 13276 - DNA, 248 bp, Homo sapiens; identical to SEQ ID NO: 13275

SEQ ID NO: 13277 - DNA, 1856 bp, Homo sapiens
tcgaactcctgacctcaggtgatctgcccgcctcggcctcctgaagtgctaggattacaggcatgagccaccacgcccagccagattattttttctttagtggaattcagccaattgaagcataacacatggcatgaacactctggaaaggtggctttggatctttccatttgttctctttagcgctgacttttgctttctagtccctgctagtgtgttggaatcttaccccatacagatgcaaactatgaaccaagaagtcagcatctatgcctagccaataattggttgttttctcgttcagagttcctcatgcccatggggtaaattcatatttcatccataagtgtgaccattgcagaagttctaggactgctactgtctgtatttttgtccttcagcatatcccagactaaacttactcttaaaatatgtttgtccaacctttggtttccttcctatggttgatattaagcctttcttctactcttagaagacaaaatggggagacaaaaaaggcaaccctgaaggtttttatcctttcagggtatctagcatttttctaatttagccctactgaagtttcttcagtaattaatcatctgtttttcagcctctaacctggctaatattatagcctacaattgtacttttaaagcccttttgtgactttgacatattgtgtctattgtgtatggaaaagtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaagaaagaaagaaaagaaaagaaaagaaacaa

SEQ ID NO: 13278 - DNA, 293 bp, Homo sapiens
tttttttgaggcagagtctcgctctttcgcccaggctggagtgcagtggcactatctcggctcactgcaagctccgcctcctgggttcatgccattctcctgcctcagcctcccgagtagctgggactacaggcgcctgccaccacgcccggctaattttttgtatttttagtagaaacggggtttcactgtgttagccgggatggtctcagtctcctgacctcgtgatccgcctgcctcggccttccaaagtgctgggattacaggcgtgagccaccgcgcccagcccaaaa

SEQ ID NO: 13279 - DNA, 1462 bp, Homo sapiens
gagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataa

SEQ ID NO: 13280 - DNA, 1462 bp, Homo sapiens; identical to SEQ ID NO: 13279

SEQ ID NO: 13281 - DNA, 636 bp, Homo sapiens
tgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacc

SEQ ID NO: 13282 - DNA, 636 bp, Homo sapiens; identical to SEQ ID NO: 13281

SEQ ID NO: 13283 - DNA, 648 bp, Homo sapiens
cctctgcctcccaggctgaagccatcctcccacctcagcctcccaagtagctgggactacaggcatgcaccaccatgcctggctaatttttgtagagagggggtctcactttgttacccagactgggagatttttctgtacttggctgtatgctttccattgatctgctgctgttttcactattattccttcttttgtgtgggtattttcttttgatttttagaattttacttgtaaacatgctacatatacatataatttggtgccctgtttttccatttacatattatactttccatattagtacattgtctgatatttctgcataatactcaattcaacttacctgctattgtttttatcatatctctattacaaacattaggcccatttcccttttttaaaagaggaaagtttgaggttatgggcggtgttctgataaaataaataatattttgtcatgtttgttttttcattgattaggaaacattgttttgaatttaatgcctcaaatttggtgcacaataatttgaagggaaaaactgacaagtttgaaatgaacattgatattacataatttacattaaaatgatacatcttttgtaaatttgtaagaagaataaataaatgaaaacctgattacctttc

SEQ ID NO: 13284 - DNA, 648 bp, Homo sapiens; identical to SEQ ID NO: 13283

SEQ ID NO: 13285 - DNA, 6556 bp, Homo sapiens
cacacacacacacacacacacacacacacactacctctgccaaccacatacctatcattgagttctgtctactcttgtagggcctcttgaaaacacttctttccatttcttttatcaggttcttatcagttgtctaatatctggccttctaactcattgcttagctttcaccagtttctttccctgctttagatcatcttgtgcatttttgtagacaatactttcctaatatcactcatggtcttgggtgtctatggagagagtgagagagagagagattccctaaattggagacaaaaaggaaaaaaaagttgggtcacttctaggatcaaatctagttctcttttatgaaggctcaaaagttttttccctctcagaatatgctaaacttcaaatgtgatctctgaaaccatccgcaagtctgagatacgccatggttttttgggttttgctagcaattctgggcagagatcctggttgtccttcaacattctacttttctgccatattattagaattttagcttggcacatgatcacccagaatagactaatgtatttcatcaattctttataaaccactaagaaataatacctaagatagggagtctaacaggttaccactgcataaatatgggacaccaaggtttataccttcagagcaaggataaaggagaaatcttccatgaagaaagagggagcaaagtgtaggggtgggttgcccctacacacctgtgggtgtttctcgtaaggtgggacgagagatttggaaaagaaaaagacacagagacaaagtatagagaaagaaataaggggaaccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaactctgagttgacacagcacatgtttcagagagcacggggttgggggtaaggtcacagaatctcaaggcagaagaatttttcttagtacataacaaaatggagtctcctatgtctacttctttctacacagacacagtaacaatctgatctctcttgcttttccccacagcaaagcaatttgcatgctcagccttggcactggttggaaggagggactgccagtgagaatttgaaccataaaccagtacacatgtaggcttgtaatctgaattcacacaaatggtatcatcctaaagagctcaagcagaaaatgtaattaaagtgaggttagtattgcccctagtgactggcagaagcatatgcaaatcctctatggaagaactcaacttcaattcaggcagacaacttagtatctcaattaaaaagatgtgataatgtgaaaaataggtgttacagaattgatgactacaatgtatctcccatccttgaagctcacaccctcccagctaggggtagccatgtgactgagttttgactaatgggatataaaaggaagtactggccgggtgcggtgtctcacgcctgtaatctcagcactttgggaggccaaggcgggtggatcacctgaggtcaggagttcgagaccagcctggccaagatggtgaaaccccgtctctactcaaaatacaaaaaagtagctgggcgtggtggcacacacttgtgatcccagctactcaggaggctgaggcaagagaatcgcttgaacccgggagacggaggttgcagtgagctgagattgcaccactgcactccaacctgggtgacaaagcgagaccttgtctcaaaaaaaaaaaaaaaaaaaggaagtactgtgtgtggttgcttctgggaaccttcctttcttgcagctgtagcattctgtttgcctcttctttctatttctctgttccatcctgctgcctggaagcagatgctgccgtttacacctgaacataagggttgcacagggggatggtagagtagtgggctgcaggggctgattcttggggctttgtaaaacagagacatatcagcactggcctgcacactttgagactttcacaagaaacaaattaaaaaattgtttaagccatagttacttgggttttcctattaattatagctgaatcctagctgataaaggacataaagattattaagacatgtttgtcctcaaaaaatggagagccaccccagggacagtttctattcaatgtagggagggctataatagatgaatatacaaagtgggagtctagggagaaatcgtctggtagaggagggcaaagagaaatctaggaagatgtttttaaaaatatggaatccttgaacaggacctggttttaaaggtttacttcagaattgaacatatttttttagtctagacctttaggggaaaaacttaaagctttcaggactcaaagacaagttactgttcccatggctaaattgcattccatatttatttgacaaatacttattgcaggtcgggtactgttttagccactggagatgcagtaagaaacttaattaattttttttttttttgagacagagtcttgctctgtcacccaggttggaatgcagtgacatgataacagcttgctgcagccttgacctccgtggctcaggccatactcccatctcagcttcccaagtagctaagactacaggtctgccccaccaccaccagctaatttttaaattttttgtggagactggagtctcactaagttgcccaggttggcctcaaactcctggcctcaagccatcctcccacttcggcctctcaaattgctgggattataggcatgagacaccacgcctggcccaacaaagttttaaaaatcactgtatttatgaagtttacattctagttgtggaaaccgacactaaacaaatagacatttcagtggtaagtgttacaaaggaaagagacaacagcataagggaatggaacatgaaggtaggggacacttttagaataagatgatccgagaaggctcctctgaggaagtgacatttaacctgaaaccttaatgatacgaaggatcaaaactattttaaaaattcggaagtggaggtgggggagagaagttctaggcaaagggaggaaatagaagctgatggctctccaccaggaaacagtggatgaagaatggagaagaattgtagggcccaagatcagagagatgagtagggccagatcatgtgggcaagcttttatgtattagcacgcttagaattaatattctgcttgagaactaacctgatatttgaaacagagtgaaaaagaaaatacctcccacagtatacttcatagcttcttatttagcccaagctgtcagggaaataaagtccagctatggctaagtttcacataatgcactgctttggagtttttgtctcatctgttagagtaagataagtaccacatactattataaggctatatagcataaaatgatgatgcattttctcctgtcattgataagaggatttttttaaaagtaaatttcttggtttagaatttgaaagcagtttcaaacttggataacacaattcagatctttttttaaaattattttttatttatattaaaaaaaaattttttttttgagatagggtctggctctatcacgcagactggcacacagtggcacaatcttggctcattgcaacctctgcctcccaggctgaagccatcctcccacctcagcctcccaagtagctgggactacaggcatgcaccaccatgcctggctaatttttgtagagagggggtctcactttgttacccagactgggagatttttctgtacttggctgtatgctttccattgatctgctgctgttttcactattattccttcttttgtgtgggtattttcttttgatttttagaattttacttgtaaacatgctacatatacatataatttggtgccctgtttttccatttacatattatactttccatattagtacattgtctgatatttctgcataatactcaattcaacttacctgctattgtttttatcatatctctattacaaacattaggcccatttcccttttttaaaagaggaaagtttgaggttatgggcggtgttctgataaaataaataatattttgtcatgtttgttttttcattgattaggaaacattgttttgaatttaatgcctcaaatttggtgcacaataatttgaagggaaaaactgacaagtttgaaatgaacattgatattacataatttacattaaaatgatacatcttttgtaaatttgtaagaagaataaataaatgaaaacctgattacctttcttatttgaagtttatttggggggtcagaatttgacttgcttctgtattatttcacttttcaaaagaatccgccaggaaagattaaaattcatggtcttcaaatgagaaatcaagtcttactttattcaaaagaaaatgttggaagcccatttagaaatgatttaatattgaagttcctatagtgttagttataaattcaaccttgacatttctcaaaattatacaaagaagtggtagagtagagctgggagttcattggggcttgtagattttgcaggaatttttttttttaatgtgttaaaacaaattttatttacaataacaggcagcagcgggatttggcctggggatggagcaaagtgaccccctgctgtagagcaaggtgagtgagtcacgcccttgacaacacattcttagaagtcatgctcgttaggggcaagttctgtttcttccaccaacgtcttcaagcctcagaatccttttctatcaaacggggctaataatagaatacaccatacctcagaattaagtgaggctgtgcaaaaggtgcttaattctgtgcctgaaatgtagcaacagacaataaatccatctaacaacaaattcttatgaagaaggtattacaataaattcttatgaagaagttattacaataaattcagtgacaagcaatgatggcaatggaaataaaaatggagaagcagatgtaattaagagatttgagaagtaaaattggcagttcctggtgactaaagcatgtgttaatgatagtgatagtgatatccttggaccattagttgttcagctttgaataccctccccaatttctctgcttattctttttttttttttttttagtatttattgatcattcttgggtgtttctcggagagggggatgtggcagggtcataggataatagtggagagaagatcagcagataaacacgtgaacaaaggtctctggttttcctaggcagaggtccctgcggccttccgcagtgtttgtgtccctgggtacttgagattagggagtggtgatgacttaacgagcatgctgccttcaagcatctgtttaacaaagcacatcttgcagcgcccttaatccacttaaccctgagttgacacagcacatgttgcagagagaacggggttgggggtaaggttatagattaacagcatcccaaggcggaagaatttttcttagtacagaacaatatggagtctcctatttctacttctttctacacagacacggtaacaatctgatctctctctcttttccccacatttcccccttttctattcgacaaaaccgccattgtcatcatggcccgttctcgatggtcgctggatgttttattttccagagaaccaaaccttagcactgtgcacgccacacctgagggcggattatcccaggccagcccaagtcagggcagggctggaaactaggggcttgttgcccagcgaaccgccacaacagagagcggactcgatcctgcgctccggccgggctgacctgcctgcgtccagcccccgcgccctgggcctgcctgggtctggatctgtgtccgagtctgggtctggatctgggtccgagtctgggtctggccctgcgctcagggcccgcggaggagactatggaccccgccgggcgcgcccggggccaaggggccacggcaggggggc

SEQ ID NO: 13286 - DNA, 859 bp, Homo sapiens
cttattctttttttttttttttttagtatttattgatcattcttgggtgtttctcggagagggggatgtggcagggtcataggataatagtggagagaagatcagcagataaacacgtgaacaaaggtctctggttttcctaggcagaggtccctgcggccttccgcagtgtttgtgtccctgggtacttgagattagggagtggtgatgacttaacgagcatgctgccttcaagcatctgtttaacaaagcacatcttgcagcgcccttaatccacttaaccctgagttgacacagcacatgttgcagagagaacggggttgggggtaaggttatagattaacagcatcccaaggcggaagaatttttcttagtacagaacaatatggagtctcctatttctacttctttctacacagacacggtaacaatctgatctctctctcttttccccacatttcccccttttctattcgacaaaaccgccattgtcatcatggcccgttctcgatggtcgctggatgttttattttccagagaaccaaaccttagcactgtgcacgccacacctgagggcggattatcccaggccagcccaagtcagggcagggctggaaactaggggcttgttgcccagcgaaccgccacaacagagagcggactcgatcctgcgctccggccgggctgacctgcctgcgtccagcccccgcgccctgggcctgcctgggtctggatctgtgtccgagtctgggtctggatctgggtccgagtctgggtctggccctgcgctcagggcccgcggaggagactatggaccccgccgggcgcgcccggggccaaggggccacggcaggggggc

SEQ ID NO: 13287 - DNA, 359 bp, Homo sapiens
gaagaatggagaagaattgtagggcccaagatcagagagatgagtagggccagatcatgtgggcaagcttttatgtattagcacgcttagaattaatattctgcttgagaactaacctgatatttgaaacagagtgaaaaagaaaatacctcccacagtatacttcatagcttcttatttagcccaagctgtcagggaaataaagtccagctatggctaagtttcacataatgcactgctttggagtttttgtctcatctgttagagtaagataagtaccacatactattataaggctatatagcataaaatgatgatgcattttctcctgtcattgataagaggatttttttaaaagt

SEQ ID NO: 13288 - DNA, 359 bp, Homo sapiens; identical to SEQ ID NO: 13287

SEQ ID NO: 13289 - DNA, 883 bp, Homo sapiens
gaattgtattcaaataaaatataaaaaagaaagatcacttagagtaactttttcctgcctcacttgaataatgcagagacacttcaaattcgtaacatgtttagggggtctcaaggaggatgggctatgcgttttgaatatatgcatataaaacaacaaatgacataggcctaataatttctttgcatgtgtataatcctctcttcaatgtaattcaaaggtctcttttttaatatcagtctttacattgtccctgtaatatagagctatacacctttcctcaatcttttgtgatagtaggaaaagtagcattataagaagtatttataaatttaattcactccaccagaaatgttttattttaaagttagcatgggacttgtggtatccgcaaggtcagtgtccccactgaagaagtggccttctagagtaagaagtttcagcatcaacatgggtaatggaagccatataacagaacttaagaaggaactttgtgctaagaaaatgtagacagtggttataggcatatatgtaagaaggctgtaagttaaaggcaagagagatgtagcaattaataggagatattttttctgccatcattaacaaatgtatttgtttactactccttactttttaactcatccaccttgtatccactgctacctctgccaaccctgtatctgttactgaattctgtctactcttgtagggcctcttgaaaatgaaaatatccatttgtttccatctcttttgtcaagcccttatcagttgtctaaactcttgactttccaactgatttgtcagttttccctgctctaaaccatcttatgcattttttacagattagctataaacagcattcccataatagcactctcatgtc

SEQ ID NO: 13290 - DNA, 1288 bp, Homo sapiens
tggccaggcgcggtggctcacgcctgtaatcccagcactttgggaggctgaggcgggtggatcacaaggtcaggagatcgagaccatcctagctaacacagtgaaaccccatctctgctaaaaatacaaaaaattagccgggcgtggtggcgggcacctgtagtcccagctactcgggaggctgaggcaggagaatggcatgaacccgggaggcagagcttgcagtgagccgagattgcgccactgcactccagcctgggcgacatagcaagactctgtctccaaaaaaaaaaaaaatgcaaagattagctgggccaggtgttcacctgtagtcccagctattctggaggctaaggtgggaggattgcttgaatctggagggcagcggttgcagtgagccaagatcctgacacagcactccagcctgggtgacagagtgacgtgtctctaataaataaataagcccaaatataactaaagtactttttgttttctgagacagaagtctcactctgtttgcacagtctggagttgcagtgggtgccatcttgggctcactgcaacctctgcctcccaggttcaagtgattctcgtgtctgagccacccaagcagctgggattacaggcatgtgccaccacgcccggctaatttttttgtatttcctttttagtagagacatggttttgccatgttggccagggtgctcttgaactcctggcctcaagtgatccacccactcgggctcccaaagtgctgggattacaggtgtgagccactatgcctggccaaaagtaaccattttgtttaattttttctttttcttttaattttaagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggagtaaagcatttaagtatttatttaataaacccttcagacctcatgctaaagaaaacacctaagtgaacattttaaattttaataggtgcttatctatagtatcctcatttctcttaaaaaaaaaaaaaaaaaaaaaaaaaaaa

SEQ ID NO: 13291 - DNA, 1606 bp, Homo sapiens
tcaaaacaagtatggattttgaatgtgaatattttaaaagatatattgaaattacttagagtagccctggatatatgttcattatggcatttatcttgttaataagtttctacatgctcattttaatttccagtagcatgagcaagtaacttatatttcattcccgagaaactaaaagaatctgcctaaagagtatgaaaattgccattaaatctgtattgtctactttctggatggttatatcattatagttctctgctcttccacacatttttgggctgctatcagtttgtaagtaatcattatacaaactaaatttaaaaatttaaacaagataattttatattacttggatcagggaaaaaaatgcagttgctgaaggtggtttcatagctaaatataagcaattattttgctttttctacttttttggattttatcatcttttcccttttagtaatagagtaatacaggtaggaattaacttagcactgccaaattaatagtaatattagaactgtgtacacagcacagggttaaggttatatagaaaaatgtctcatccatgtttaatttggctgaccagcccagttgattagccaattttattgttttgttaaattaaaattctaaatatagttgtccattgttaaaataagtgagtagggttaaaatagagaattgataaaaataaagccttaaaaatcttttagctaaagtagcaggcttcaagtgaaattcagttttggtctcctttacaggaatagctattcagtcagacagaaccacttatcacgttttgcagtatctcctgaggaagtcagaattctgagccagcatgaagacggaatcttgtctttgatctgatttgcaaaccgtacttttattctaatcatgtgcaaggtggaggttatagcgtgggaactaaaatcttagtaagtgtggtttttattttagctattaagtagtatactttcttatagtgatttttttttcttcttagcagagttcacactataaatggtgtatggacttggcaggcaggaacataatacagtatacttcaaaagtgaaagatttaggccaggcgtggtggttcatgcctgtaatcctagcactttgggaggtcgaggtgggtggatcacgaggtcaggagttcatcaagagaagcccggccaagatgctgaaaccctatctctactaaaaatacaaaaattagccgggcatggtggcatgcacctgtaatctcggctacttgggaggctgaggcaggagaatcgcttgaacctgggaggtggaggttgcagtgagcttagattgcaccactccactgcattccagcctgggcaaaacatagcaagactccatctcaaaaaaacaaaaatgaaaacaacaacaacaaaaaaacaaacaaacaaaagatttaaccctctaggttcaggaaaaatccctgagaaagagagagcaaagcttctatactctgcctaggatttctttctctttccgggtgaaaaataggtgttgggatgatactgagttgataaaagtatttaggaaaagtggccagtgtctaaattcaagccattaaaaaaaaaaaaattaaatt

SEQ ID NO: 13292 - DNA, 1606 bp, Homo sapiens; identical to SEQ ID NO: 13291

SEQ ID NO: 13293 - DNA, 677 bp, Homo sapiens
atgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaa

SEQ ID NO: 13294 - DNA, 710 bp, Homo sapiens
gaagagatgtggttttgccatgttgcccaggctggtctcgaactcttggattcaagcaatccacctacctaggcctcctgtgctgggattacaggcgtgagcacctagccactcttcaatgaattttaccttgcagttactaaacaacattcctgcaatgtttcaagttctctcagagtgaacactgtacatcattacgtttttttttttttttccttgagacagccttgctctgtcatcccaggctgaagcacagtagcacaatcataactcactgtagtcttgaactcctgtactcaaatgatactccttccttggcctcctgagtagctgggactataggcacaggcgactgcacctggctaattaaaaaaaagttttttttttggtcgggcatagtggctcgcgcctgtaatgccagctctttgggacgctgaggcaggtggatcacttgaggccaggagtttgagaccagcctggccaacacagtgaaactccgtctctactaaaaataaaaaaattggctgggcatggtgggatgcgcctgtggtcccagctactctggaggctgaggcaggagattcacttgaacctgggagtgaaggctgcagtgagccaagattgtgccactgcactccagcttgggtgacaaagtgagactgtctcaacaacaacaaaaatcgtgtttttttttttttttccttttttgt

SEQ ID NO: 13295 - DNA, 710 bp, Homo sapiens; identical to SEQ ID NO: 13294

SEQ ID NO: 13296 - DNA, 677 bp, Homo sapiens; identical to SEQ ID NO: 13293

SEQ ID NO: 13297 - DNA, 1217 bp, Homo sapiens
cttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctgta

SEQ ID NO: 13298 - DNA, 230 bp, Homo sapiens
ccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagt

SEQ ID NO: 13299 - DNA, 362 bp, Homo sapiens
gggcgcacagaggagttcaggcaatgacactggacatgtcatcagccctgggcaacttcaggcgcagtgttgggaaaagaatagacaaggtcccaaggtcaattccagcgcctggatcctctgatcccagcctcgctctgcaggcaagcccaagaactccaagcacaatcgccaagatgctacccaaggagggaagcaagatacctgaaggacacccaaacctcagtcattctaattcttgggaccacacaagaagactgaaaggtattattttttcaaattaatttgaagtgtcagcagaaaacattttgtttcattaaagacagcaggcctcaagaaaaaataaatcaatgaacaaataa

SEQ ID NO: 13300 - DNA, 1960 bp, Homo sapiens
caagctttctgaaatgcgtaagttatgatacatttgaaaagtgtaacatcactgatgctccttgccataaacttaggcaatatgaaacaatcttgctcttagaaccacttcaaatgattggtaaattggggtcacttatggtaattttatttataatctttaatcttgtatctacatctcttttctcctcttccttctcttacattcagtaaatctaaggcttctttgagtttctgtgccctctcttacctattggcaatgtctgtaaagacacagctcacctctttcttctcttctgggaaatattattagccattatgctttcagcccacatttgttcacttattatttccctgtgtagaccctacaaaatgggaaccagatctttttctatagttttagataaaggtagtctggcagttttctagagaaattcattattagaaatttattctaatgggaacccatttttggcttactctgttggttgctttgacctctgtttttccttgcagagctcgacttattaatatcatttaggagcactgggaaacatcattctgcatatttatcaggcaattcatacacacatccctacagttcagtgtatagagcttctctgttttggacttaaactgaaagattttaatgactggtcgtattggcccagctcctaatatgcagatgaatcattgtgtctgcactgcggagtgttggccatctttttacttctgcttttcttaagtagatgcaaatattgaggggatcctaaagaaggacaggaagagtaccagcatttttttttttctaaatctgccactaaagtccctttggattggattttagatagtcatggcatttgaataacctgcatttattaatctctggaaataagtgaaaaactagaaaaggctgaacgtacaatcaatataatgcaatactggggcctaacaaagtggataaatgatatttatcagcaggcgactgctgtttaattcacaggcacaaatgcccacattcatctgtgacactgaatcagttttcttgtgagtgttgtcttccctgaggtttctttctcttactcttctctccttgctcaaatttcagagttgtcatccacaattctgggaaaggtgatgtttcacttgcttcattcaataaagatggggtttaggggggtgacacaaggtatggctaccaatgtctaatgctggtattatatcctttatccagtatgctggggagaaagtacaatcattttgctttacttcatagctatctggttcattaaatcccatgagtcttggtaaattatgaagcaattattgattttgttgtggtcaacatcaagatatatattgattttcccaccagtcaatagtttccagaggcataatcaatattgatgtttgctgaacatgtgtgttaatgtcagtgtgggtatatgtacttagatctctacactcagatatttattttatactctttctgaacgtttttgtaaaaaactattttctcccaaagatcctattattttttggctgatttattcagttcttcctttttgctttacatttttaatctcatttattcttccccggattgataatggaaaggaaaactaaggctttggaagaagtctatttgcctttaatgaaccggttgggggtgagtcttcctgatgagattgtgattaattgcaaagtgagtattacttcttgtctccatcctgtcggttcgatagaatgacaaaaaaagttgaagactttcactctccattccagcatctaccagaccaacataactcagtaagcacatctgagaatccccctcatttactcccagtacttttttcaattatgtggaacatagacgaacaggtcaaacttggatttagacaaagttaaatgatcaactacatgatgcaatttaatgggcacaaaaataaaaaaaaaaaaaa

SEQ ID NO: 13301 - DNA, 1960 bp, Homo sapiens; identical to SEQ ID NO: 13300

SEQ ID NO: 13302 - DNA, 303 bp, Homo sapiens
gagacctctagaaatggcatcattaggccttcttctttctgagttctttccttcataagttatgtacctgataaggactttatgcatcagaaagtatggcgtagtatagaacaatacaggcagcatggcacagtggaaggaactcagggctagttgtcaagagatttgggttcttctgcgtgcttaatgctagttttatgatttggacaaatcacatcgcctacctggacatcggtgtctacatctgtgggatgatgatgatgatgacagttaagtgcttaacaataacgaactcatttaatc

SEQ ID NO: 13303 - DNA, 303 bp, Homo sapiens; identical to SEQ ID NO: 13302

SEQ ID NO: 13304 - DNA, 1484 bp, Homo sapiens
gtgaacgtggcatcctggacttttgcactgctcatattggtaaggcaagcaccacccctggcacacacacggtcaggcatgacataaaaagatgttgctaagggacattgaggtctatttcttgggacaagtaggaattttctatccctgttcattcttcatcttggccacacacatttgctctcttgctcatcccacagcgcctcccacaaggccacgctggatcctgccacagtgttaggttacatttccttccttctggctcaccagatgtggacctgactgggaaggctggaagctactgtccctggagccctactctcctggcttggtgcctccatggggaatgacagtgggcactctgcacccacatggaagggagtcccacaccttctaaggtctcctttgtaacctacctctggctccccactgtgccacatccctgtaccatggcatctgtgtcttttggacagcaccgggctttcaggatgactagtcagggttgtcttgtctggaccagatgctttgagggtgcagccttctgggaattccctctagggattttctatgatgctggcttccctgtaagtcccactccaggcccgggtactctgtccaagccccacagcagaagaggctcttcaggggcctcatttggtgtcaactcagcaagaagtgaagtttaaagcccagagcactgcagggcattgtactggtgtaggaggggtacatccagggctccaaggtgttttctgtgctgagctcatctctcatcccccagccaccacagtgctgggtcatagctgggctgttgttttcctatggcaggcccagccctgtctagctctcagttcctctgctctgcagccagggcccttggcctgaaccctacacatagcagcactcactcgggctgtaggtattcttcagtacctgctatggcctggcatttagggaactctcaagcaacagcacaagtgaggcccctgctctcccgtgctttgggtccgttgtaacagcataaaaagcttgtggagtatcttaggtgagtccactcttgcagctgggcaggcatcatagtgttcggctccctgttacagtgtcgtttcttggggacatagcagatggaaaattctggggtagttttgatttagcagttatcacatttgctgttcatggagtgtctgcaggggctaggcacccctcacgatgcttgtgtctgccagccatggtggctcatccctgtaatcccagcactttgggaggctgaggtggtagatcactcagggtcagaagttggaaaccagcctggtcaatatgacaaaaccccatgtctaccaaaaatacaaaaattagccatgggtggtggtgtgcacctgtagtcccagctactcagaaggctgaggcaggagaatctcttgaacctgggaggtggaggttgcagtgacccaagattgcaccattgaactccagcgtgggcaaca

SEQ ID NO: 13305 - DNA, 1139 bp, Homo sapiens
ctgcaactgtggcaagaccgtgtgtcctgtcagagtgggtgaccagggcctttgccagcagacgacttatggagaaatgtttgagtagatggaggaaccgatttcctctggaatccagaggtacagaaagcaagggtctggctcttttcttctgttctgagtctacactatggcccttcccagcttctaggctccaggttaaggggagtggctggtgcaaggtgggtggccagagacgaggtccccatgaagccttcagattttaacctgagatggagaggcagcttttaaacagtacctttcaccactaggcatacaggggcctccctactgactctccagacctgtgggggaggggagcggatcacctctccttgagagggtgagcctaagccgtgggcattggggtggggtacctggagcattctaggtgttcggggctattaatatttatgtattattctgacaactaagggcaggatgtgtgcttcagtgggcactgtagtttgaatacctggatgccaaaaacagaaaacaaaaaaacccacacccttgagtacacatgatgggagtgaagcagtcctgggtttgagtccccagtctctcacttcgctgtgtgactttggacaatgtattctccccatccacaaaacagagctaataacctccacctggtaacatagggatgggcactggtgcagggaatgtaaagtaacgagggacgtaggaggtactcattgctgtagaggtaaacttgacctcttttcgacccttcgtacaactgtattagtccgttttcacagtgctgataaagacatacctgagactgtgcaatttacagaaagaaggtttaatggactcacagttccatgtggctggggaggcctcacaatcaccgtggaaggcaaggagcaagtcacttaagctctttgcatggcaccatcgatgtgagctaggaaactcttccctatgaaaccatcacattcactgtcagaagaacagcacaggaaagactcgcccctgtgattcaattatctcccaatgggtccctcccatgatacatgggaattcaagatgacacatggtttggctgtgtccccacccaaggataatacaggtggaacataaatgccagcttg

SEQ ID NO: 13306 - DNA, 567 bp, Homo sapiens
gtcattcacacttcatgtatagcttcttattataagggcaaagttgagttgtaactgagatggaatgcctccctggagcctagtatgtttagtctcaccctttataggaagtttgccaacctatgggctagaatactgaggctgatgtacactcacatgtaaagggaataccttccataccacatgtagtgatatggaaaaaatctccatgacattgttactaagaggataaagcatggaagagtaccacacaatacctttctaattttagaaatagcaaatatgggccagacacagaggcttatacctgtaatcccagtactgtgggaggccaaggtggttgggtcacctgaggtcgagtgtgagaccagcctagccaacaagaggaaaacccatctctactaaaaatccaaaaattagccaggcatggtggtgcacgcctgtactcccacctacttgggaggctgaggcaggagaatcacttaaacccgggaggtggaggttggagtgagctgacattgtgtcattacattccagtctgggagacacagtctcaatctacaaaaa

SEQ ID NO: 13307 - DNA, 558 bp, Homo sapiens
gttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaatggacacag

SEQ ID NO: 13308 - DNA, 230 bp, Homo sapiens
gatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcagg

SEQ ID NO: 13309 - DNA, 888 bp, Homo sapiens
aaacattttaaaagtgaaatcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtcgcccagcctggagtgcagtggtgcaatctcagctcactgcaatc

SEQ ID NO: 13310 - DNA, 864 bp, Homo sapiens
aaacattttaaaagtgaaatcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtcgcccagcctggagtgcagtg

SEQ ID NO: 13311 - DNA, 2049 bp, Homo sapiens
agcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatccccttcatcctgttctgtacttcattttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaaatgctcagtgttcagaatgctgctacttaaatgacatcctatagaactgcatgaatcgggatacatttaaataatccagttaagtggctgtttcttgatggttgaggctctgcttttgggttgtagaacactgggaagaagtcttcacagctcagatagttttttagttggtctcatttcctttctacagtgccatgctgtcaggcaaagttacatattgcctgcatgcccacacctttctgtgagcatctgaaatcttgctcactcctgtgtatgagcaccagaccatactggttggaagcttctttccagtccccgctttcatccctccattggtaaaacatctggtggggaggtcttcgtgtggtctttgggcctacctgtgggcgctggtacagtgagactggagagatgggtgtgtattcattctgcctcccactgaagcaatgacgtcttcttggtgtttgggtctctgggtgcccccactcttcctgtaaatgttaacccccacggaggtgaggggaatggagaagcttatctcagagaggctctctggagagggaggaccacttctgctttccagggggaagctgtgtcacggagagcagaactgtagcccgatgctggagagaaaaggccccagaggaggcaggcaaggaagtgatacttcctccaccccaggcccctgggtcatttgcctgcagccccaccttccttaccacccaatgctgcgttttcctcggggttctttctaccctctgctgccctctgcattttcggtttgcccttaagtgaggggtggggcggggtgggagagaggagcagtctagagtcttaagggcagagcctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatctttttttttttttttttgagatggagtctcgctctgtcgcccaggctgtagtacaatggtgcaatctccactcactgcaacccctcctcccaggttcaagcgattctgctgcctcagcctcccgagtagctgggattacaggcatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggc

SEQ ID NO: 13312 - DNA, 2501 bp, Homo sapiens
gcccgcggacagttgccctccctggtggccccgggcaggagcgtgacgtcgaggggctgcagcggaggctggaactcaccctcccgctgcggcgcctctcggcctgccgaggagcagtccggtgcttttgccggctgagaggaagcgagagttattttaagaattcaggggttgcctttccttcgccttgggggaagggcgtaagagtcagttcccactttcctgcattctctgggcccatggtggcatcttttgcttgcggtgcattcgtaactttccaacagcctgcctgtcatgtggattagcggttgtgtttttgtatatccgagtgtgttaattatcccaaattcgcccttcttcgccagctcagaatctaggccttgcacttttctggctgtatatttaggggaccgattattgaaattccctgtttgagtttcttcatctttgagagagcatatatacctcaggggctgtttagtacacacaaagcccctagtacgtaccaagcatttcataaacgatgttactgttatttattgcagtgaattctattcatataaatgaggcttcttggttctttgcagcttggtgatgttgaagctaagactaccatgtcagatttagccatctgaccttattagtaaatctgcttaataaatacatgagggatttgctgtcccaaagcagggcccagtagtctgactttccctaaagaactagccaataaactggtgggctacagggatgttttctctgtacagccaacacctaaagccatgccctggggaataggcactgcaagaacccaggccttactaagcccttctctgtaagagtaagctttgttgggaaagggtgggatccagttagtccctccattctcatttggaggtaagcaggtaagcgctttgaggcctgaataaatttcactggatcatagagtctttggtgactgggcctctttggatgtaaatgtgtggcccttttgctgagtgaaggatagagggcagcagatgtaaggggagagaaagtaggagccaggaaccttgagttttggcctcttccatcatttaatatgctgtgatttgggataagccacttgggccatttattcagccaagatttcctttatagcagcagccagagttatattgatttgtctgcaggttgatagtctgtattaaccattacagtggaagctccatgaaaactgcttcatctgtcttgtccaaaatgatagccccagtgcctggtacatagtaggtgctcagttcgagattacttggaagaaggaatgaaggcctcctgtgagcttgccctatgcaaaactgaggacatagggagatgaagaaatagagctggtccctaaggtgtttgaagcctactggccctttctgttgtggtttctaaaacggggatttgagaggctttgttgactgtaaagttacccagcactgagttacccacatttagtgtgggtaactaaatgagagtctccactcagcaccgctcttctctacttattactggaagagaggtcctgatgtggggtggttaagatgtttcctgcaaaggtagttggcccaatccagaagacctacattattttagagtcattggtgttacaaaggtaggtcgaaactttgtaatcccgcccctgccctccaatagctttcttttagcagaaaagtggtccagcactgttcaatgactttgaaagccttttacttctatctgcaatatttgtttttagataaatcaccaaaaacatctgagattccagttggttcacatgactatgtggagttgtaacttaacaaaattaaatcatattattcatgtacaaacccatactaactttataaataaggacaccatgtatacatgcccacagcagggaacattgttataagctcactcctactgatgatctcagtgatgcatggatgagtgttaacattgaaaggccaccacaatcattagtcaggacattgatcaatgtcacattgatagcagagatagcctcagacctttactggctcttcctagtgatgatggtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtccacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttga

SEQ ID NO: 13313 - DNA, 441 bp, Homo sapiens
gtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtccacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttga

SEQ ID NO: 13314 - DNA, 2047 bp, Homo sapiens
agcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatccccttcatcctgttctgtacttcattttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaaatgctcagtgttcagaatgctgctacttaaatgacatcctatagaactgcatgaatcgggatacatttaaataatccagttaagtggctgtttcttgatggttgaggctctgcttttgggttgtagaacactgggaagaagtcttcacagctcagatagttttttagttggtctcatttcctttctacagtccatgcttcaggcaaagttacatattgcctgcctgcccacacctttctgtgagcatctgaaatcttgctcactcctctttattgacaccagaccatactggttggaagcttctttccagtccccgctttcctccctccattggtaaaacatctggtggggaggtcttcgtgtggtctttgggcctacccttgggcgctggtacagtgagactggagagatgggtgtgtattcattctgcctcccactgaagcaatgacgtcttcttggtgtttgggtctctgggtgcccccactcttcctgtaaatgttaacccccacggaggtgaggggaatggagaagcttatctcagagaggctctctggagagggaggaccacttctgctttccagggggaagctgtgtcacggagagcagaactgtagcccgatgctggagagaaaaggccccagaggaggcaggcaaggaagtgatacttcctccaccccaggcccctgggtcatttgcctgcagccccaccttccttaccacccaatgctgcgttttcctcggggttctttctaccctctgctgccctctgcattttcggtttgcccttaagtgaggggtggggcggggtgggagagaggagcagtctagagtcttaagggcagagcctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatctttttttttttttttttgagatggagtctcgctctgtcgcccaggctgtagtacaatggtgcaatctccactcactgcaacccctcctcccaggttcaagcgattctgctgcctcagcctcccgagtagctgggattacaggcatgcaccaatgcaccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggc

SEQ ID NO: 13315 - DNA, 1132 bp, Homo sapiens
gttgacatgagtcatactttatgcggatgaagaagctgaaactcataaaacttgtccaagatgtcaaatcagaggttcagagaagagtgattactttgagtgggtgttcaggagggattgctggaggagatggttctttgatctgggccttgtaagatgggcagaagttgagtatgtggagatggtaatggccttcagaatttatgtcttatctgtttggcctggcatacaaggcctttgacaatttggcagagtctggcttttttggtaggtctccagccagctcttcactttgtttcagccacttggaaccaagccacatcgcctgaatatgcaggtatgggtgtttcagggctctgtgccttagccaagagtgtccgttctccttcacctccctcctcctacacctccctcctctttctcctgagctctttcttatacatccttgggcatggcctatatctgctttacatctcggggtcagaacctgacccatggcaagagctcagtaaatgataaatgaatagatggaggttgagccttggagaagacaagtaatgagaaaaaaaaatactttgttggcctcatgtccttcctgtcccttttggggcagaaaggctcattcacaagtccaggccaaagtcagcacaggcttcaatttcattggctcaggccggtacacagatggggtgcattagagcttgatgatttaaagggttgggtgaaatgcctgactgtggggagagctgagggagctgtggctggcattgcacaaagcttcctttatttcactccacagccacccccggcgttaaataatctatagattcttatgcaggtctgcctaatggaaagatcattgccccagcctcctccttggaaaataggcctttcttttcatttttccctccctcttccatttaagaaagttcaaggagagaatgtctctcctgttctcctctcttgacttaatctcctatgcagtttcagaatctgcccagtgggagttaggagctgggaagcagataactggagctggatcagcagtgtaattaaatgatactttgtactggtaatagggcctttcatctgaaagcttgacattcgtttggtgcaaaaaaaaaaaaaaaag

SEQ ID NO: 13316 - DNA, 378 bp, Homo sapiens
taataagtaaataaaccaacatgccagttgtgcagttcaggaaatggatccttcagggagcgttctcaggggaactgcttccctcctggccctagattcccaggggaagagaaacaggttttactaggctgcatgacaaagagaaagagataatgggagacttttcccttacaaaagcatctttacccagaacctggacttcacgccattaaagtaaaaaaaaaaaccaacccatctttacgcagaccgagacgaagttttttgttttgtttttaaatgtgttcctcatctgtttacaagacctgctggaaaaggtggctgttgctttctttgcctctggtttggtagccccagccagagaggaatgaaggatctagt

SEQ ID NO: 13317 - DNA, 1420 bp, Homo sapiens
gatagaatcatcactgcataggagccaggaaatttagtttccagtcccaggtagtccttagctgtataatcggaaaaagttactttgcctctttgggcctcaatttctactaattctatgatgacacagttggacttagaaattttaggatgctaaggactgacttaataaagctttcctggtatctcagacattttttaaaaggctgtatatgagtttgtgtatatgtgtatgtgcacatgcatttctggaaaggcttcccctccaaccattaaatatataattaatgttataaattgtgttgtttataattgagaaataaataccacacttgacaatgtctatttccaaagaattgggtatttttgtgcttttgtttattcctggtattttcatatcatcctgttacacacgtgagcagagaatgtgtgtatcatccatatttaatttacagtcatagctagactaagttattatccaatgttattgaaagaatcagtagcacagatagaaatgaattagttcctagtatacagttttcttggcctttctcttaaccagtttgctttcttagagaaatgaactgatctgactatgattaagatcatttattgctagacagaagtaaaattagagattatccatagaacattttaatcttgtaatttatttggtgtgttgtagaacacctgacttttctcattgtatttggtaaatgtgttaaaaatgttaagtcagtgttatctggttttattttatctcttgagtcatgtttggcatgtatgtgttgggggggtgggcataggagttacacatttaagaaagccctatcttttagtagaataaattaatgcagattggcctgtcttcctgcctgcctggtcagtaacagtggactttggagattgatctagtgatgataaacctattgtatgtggcataagccagagaagtcagcttcgatagcaagtttctacattggcgtgagagagaagcatttagttaacatttcaaagtaactaagcctgttagcatccatgtattctatcagtagactttattgagtcctgtcatttgtatggtcttttattgttttttgttttcaacaaaggaaatagcacacacatacatctcaaaatggattatacctgttgtaatctcagtattttgggagatcaaggtgggaggatcacttgaggccaggaatttgaaaccagcctgggaaacatactgagatcctatgtctacaaaatttttaaaattagccaggtacagtggtatgcacctgtagtcctagctactcgggaggctgaggcaggagaatcacttgagcccaggagttcaaggcagcagtgatctgtgatcaaaccactgcactccaacttgggtgacaacatgggaccctatcttaaaaaaaaaa

SEQ ID NO: 13318 - DNA, 2548 bp, Homo sapiens
cttttggaccacaaagaagaagaagagttgactgaagaagaaagaaaagcagcttgggctgagtatgaagcagagaagaaggtagttgatgcaaaatgtgtttttgtttttgttatgttagtgatttgaaagagcaatgaagaagaaaagggtcacatttgaaacaggtaataataatatagtgggttttaggaacacattccccaattacaagaatctctttatgggttggtttcagctacctttagtggtagagtaggaggagaagacagaagaaaacagtttacacttaaagagtagtaatcccatttctgcctagtatttgttgaattgagaaatgagtgggaagccatatatttagcatcactaacctcccatcagtaccctctctgtagtaacaaacatacaggagcttagtgtttggaggttgtagtaaatgtagctttgcatgtataccatgaaatctaaattttggctgaatatcagaacacaaaaatatttcattattagacattaatgccatttgctccagcagcaactttatttaagatcattctatgtctgttttaaacatcaacccacttgagcaaaaatgtgcctgagcatgggaaaccttatcctaatacctgaatccttttcaaactcctaacttattgtaccaaacttctttaacattagtgtgatgttcagagtctcatcagaattctttgagttgcccccattctgtgggaattatcagaaaaaaaaagtacacctttaggggttaaagctttccttgtaataagatcttggtttcgggtgaaaagggtgttttgtttgtgtgtggaagagtgttaataatttcctggatctgagaatgtggattcttttctaaaccagtaggtgatgtagaatttcaagttttaaatcacaatgtgaaaagtgcataatttttttgtttttagggactgaccatgcgtttcaacataccaactgggaccaatttaccccctgtcagtttcaactctcaaactccttatattcctttcaatttgggagccctgtcagcaatgagtaatcaacagctggaggtgagttgtgaagtacaaaagtagtttgacatgaattaaaggcaatttcaagtgccttgttgttgagggttccctatgcagaaatatcacattctccaaaagattacccctgaatagacgaataaatttttgttttatttgttgaccgttttgaaccaacatgatgttgtaaaatgtggtttgttcagagcacaaaggaatcagtcggtgaattaatgtagtttgaattattttaattaagaaacaatagggctgctgactcgcttgggaaatagcaccttcttcagttataaaatagttataataaattgctatcttactgtttgaaagtaagataaatatactcattaacttctattctagtgcattatagatgcacaattaaatatataatgcccaatattatgaaataaatgatttaaagctagaatcaattgtaaattaaataggaaagactgggtttttattataccaataatgacttaattgaatctgaaacacattataaaatgtgcttatggattcttctgcattattaaattattggtgtgataaaactcaaacttttttaatcttcctaacaagactctttgagcattgatatggtttactccactttattgatactgaattttgctgttctcttcaattatttaaagagttttaaaaccgactgctctaagttggcaaatggaaggattccctatactttaacactatgctgtctttctgccttatataacttatttcttgcattcttctaggacctcattaatcaaggaagagaaaaagttgtagaagcaacaaacagtgtgacagcagtgaggattcaacctcttgaggatataatttcagctgtagtaagctaattggcaattgtcttattccaacctccaatttgtaccctccaccccctactgccatttttttaaatttttaattgttccttcttataaattgatttgcaatagtaaaatactggtaaaatggatggataatgccaaaccgtaacccagcaattttacatagatgttggcacaagagagaaatgggtaaaatgtaagaattgagaaatcaaacatggaaatgtatgcattgtttatataaacattttaattaccagttgtacaaattaaatctaaattattgtttcattccagagatagccagcccaggtacagcagtgaacaacttagtaccctgttttgcatcatgtttttcttcagaaaagaataaaggaaaaggggggtttgaaaccttgggaaatcccgaatatcttaaaataccttaattatttttcctcaattgtacagtaataaggagtaaatagaaaatttttcttttagtggaaggagaacatgaatctctcagaggcccaagtacaggcgttagcattaagtagacaagccagccaggagcttgatgttaaacgaagagaagcaatctacaatgatgtattgacaaaacaacagatggta

SEQ ID NO: 13319 - DNA, 98 bp, Homo sapiens
tgaaatcccagcactttgggaagccgaggcaggtggatcacttgaggtcaggagttcgagaccagcctggccagcttggtgaaactccatctctacta

SEQ ID NO: 13320 - DNA, 1338 bp, Homo sapiens
attttctgtgaattttgggaagaagagagttaaatggaagaaagaaaaaaaatcttgcaaatacctttaggatagtagtttttttggatacagtagacattgtttgaaatgaatgattaaagctgtacttacctttcttaaaattcactgcttgggatgggctggtaacagtttcgaggttactctcattaggcttcagtgttaagtacactataccccattttcttgggaagtgaacagcaacatctactctgttaaaatcattatacattgtgtctgctttcagatttcttccttttagtaattagtgttgtgtatgtgttagatttttttttgtctttactgaaacacaccctttggaattcctttagcgaatatgctcttttgggtggataacctaataagctttcctctttgagttttctgtttttttactcagcacagccatggaagtagggatttaattttctgtcaaactctgcatctcacaaagcaatagttactcaaaacacgactttcaagaaggttattctttttaagctttcagcagatgagctgagtagcagcaggaaagcaggtattgagaactgtcttggtttttgtactgctgttgagtagtaacattgcagctgtcttaaatcctgaatgacacagaagcttatggctggtcgtactacatagcaccttgaaagtgacagggcttttcatttctatctgatttctgtttttcaaaaataaaactccttattcttttcctatcattgtaaatattcttcagcttcctatcactaatacatagtctcggcattagagaccagttaaaataaataggctgaggaaaatcttgatagtaggagagattttggagcattcattaaaagtaaaaatagggctgggcgtggtggctcactctcccctgtattcctagcactttgggaggccgaggcaggcagattgcttgaggccaggagtttgagaccagcctgggtcttaaaaggtagatattattctcattttacagatgacgaaactggagcttgtttgaaaagtttgcccaaaattgtagcagttagcgtgaggggcctgcctctagagaccatgcaaattcaacactaagctatactggactggtctcacatagtgagaccctgtctctacaaaaaatagaaaaagtagccgggcatagtggcccacacctgtagttccagctacttgggaagctgaggcatgaggattacttgagccaaggagatcaaggatgcagtaagccatgaccatgccactgcactcgtgcctggacaacagtgcaagaccctgtctcaaaaaaaaagagaaaag

SEQ ID NO: 13321 - DNA, 841 bp, Homo sapiens
aacggggctttatttttatttagttatccacagatctaggttgtgtcctatattcatggctggagacgcttcactacaccgttcattgtactactgccagttcctcatcgtctgatacagtatctcagggttctcacagaatcttttacctgcaaaatgcagtttgcatcagttttatactctgcttgctctaagaagctgtgcacagggtgactgtgagagagacttctctttgaccttctgcgggcaccatctccctgcactttctttcccaaacaagatacttggcagctcagattctgaaaaagggattcctttcaagtgtagattaggacttcagctctgctccttaggttagttagaaataatgtggagctatttctggagtgctgagccttggtcatttatttcattcctggtggggaccccagagtcttggggatctgccggggaaagggagccttatgcaagagcgtcatccccaccatttccactggtacacagcttggagctgtgatctttctctggttacctgagcttgccgatcacaacatggaagtgcagggggaaagccgccggtgcttgtagcagtaaatggattgaaaaagcagttcctacatttactttctcctgctctcctgggagcagatcatggtttagtttcgagaagagtgcagcagctcgagaccaaagagttttgctttgcttgctcttgactgtgcagtagggaagccagcattctcagaagaccagaaaggatggcggtggggaagggagggagacaggcctgtttaaccgagaagagacaggtgccatccccagggtgaggccttcctttcag

SEQ ID NO: 13322 - DNA, 5754 bp, Homo sapiens
aagaccatcctggctaacacggtgaaaccctgtctctactaaaaatacaaaaaattagctgggtgtggtggcgggcgcctgtagtcccagctactctggaggctgaggcaggagaatcgcttgaacccaggaggcggaggttgcagtgagccgagatcgcgccactacactcagcctgggcgacagagtgagactccgtctcaaaaaaaaaaaaaaaattacttagacatggtggcacattcctttaatcccagctacttgggaggctgaggcaggagaatcgcttgaacccaggaggtggaggttacagtgagccgagatcgcaccactgtgctccacactccagcctgggcaacagagtgaaactctgtctcaaaaaaaaaaaaaaaaaaaaaaaaaaggaataaaggggatgggtttgacatctgacaaaatgctgctgctgccatccgcttctgcaaaacctcaagaatgaaatgtccttcccatggcccacacgaggccctgcacgagctgcttcatccccttccaaacctcctctcctctctcttcccctcctcactctgctcagacacacgggcctcctcactgttcctccaacacgccacgtgtggtctgccccagggcctttgcacaggccatgcctctgcctggaacacctgcccccagattctcctatggctgacttctcacacttgggtcttagtgcatgcatcacctcctcagggagggccccctgcccacccccagtgaatctagccccattcaggacagtcatctttattatgcactgattgtatactaagcccagagacttcaactgtggtttctttttcatcctcccaataaatccatccatccatccgttcactcagacatgaaattctggaccctccaattcaggatctgggccacccagtgcctagcttttttttttttttttttttttttttgccgacagagtttcattctgtcacccaggctggagtgcagtggtgcaatctcagctcactgcaacctccgcctcccgggttcaagcgattctcctgcctcagcctcccgagtagctgggattacaggtgtgccaccacgcccggctaatttttgtatttgtagtagagacggggtttcaccatattggccagactggtcttgaacacctgacctcaggtgatctgccctcctcagcctcccaaagtgctgggattactacaggcatgagccactgcacccgtcagcctacttcttgtgttcattcattcattcattcattcattcatcattcagcaaatgtctatgagcgcctactctgagccactgaaccagctgggctggccctgggggagaatcgacttcccctgcaaattcactctcatcagatccccaggctggtctaggattgtttagatgccctcacgttggggaactcattccttactaagaataaccaccaccaataccaaacagtctcaagtaccaccaatagtgctgagttctcagggtgactacagcatctgctcccaagcccagcccagcccatatggtgtgtgctgtgtcaaagaacctgggttcaaatcccatgtccttttctaacccttggacaagcccctacccattttgtgcctcggtttccctagctgtaaaatggagatagtagtgcctctcttgtgggctcagcaccaggcctgttacacagctggtgcttaataaatgtgtcctgttacttaaggtctgatatgtgtagctcctgtcgtcgccgtccatgggggtgagtggggtggggaaggggtggtttgagtttctgcacatcaggacacgaggcgcggtccatgcaaatgaaatgcaaatcccatgcaaataaatctctgggtggtgcaaggctggaggtacaaggtgcacgcatttggggggcgcctgggaaccccatgaatcgagcccaggcccggaggtgctgacccgcatccagcccggctttcagtgctcggtgtaaatgtttacacctggccggccgccaggctccacgccgccccacactaggcagccaggagggggaatgtaaactcgggctgggggccgcgggacgctcgggaggagcccagacggagtcgagtgtggtgggtgtgtacacgtgagttattaaacaccgactgtatgcagtgaggaggatgccaccaggcactcacagcaccaagtaactggtgcccgaatgggtaaagctcagggcattcctgggggcccactagcgcccctgcaccagccagaggttgaagtgaatagggtaggcagccatggaaggctccctggaggaggcaccctccaaggtgagattgcaaggggagtgagagctaggtacatgtgacttcacagcctgtaatcgccagctctttgggaggccaaagtggaaggatccttgagcccaggagtttgagaccagcctgggcacgttgtgagattcccctctctattaacaaaaacaaaaacaaaaaaaattaaaaattagccaggcatggtggctcatgcctgtagtcagtcctagctacttgggaggctgaggtgggaggatcgcttgagcctaggaggtggaggctgcagtgagctgtgatcacaccactgcactccagcctgggtgacagagcaagaccctgtctcaaaaaaaaagaaagagagagagaaagaaagaaaggaaagaaaggaagagaaaagaaagagagaagaaaaaggaaagaaagagagagagagagaggaggctgggtgcggtggctcatgcctgtaatcccagcactttgggaggccaaggtgggcggatcacttgagttcaggagcttgagaccagcatagctaacagggagaaaccctgtctctattaaaaatacaaaaattagccagtcatgctggcaggtgcctgtaatcccagctactcagggggctgaggccggagaatcgcttgaacccgggaggcagaggttgcagtgagctgagattgcgccactgcactccagcctgagggacaagagtgagactccatctccaaaagaaaaaaagaaaaagagaaagaaaggggagtgggagtggggagggagggaagaagtgttctccatgcaaggacctatctgtgcaaaagcccagagctgggactccatgtccagggcagctctggtccattgctgcccacttctgggcctgcttatccatctggatgggaaacaggctcagagaggggcagagtcaatggaggacaccagcatgtagggaacagtgtcagccccagattcctgcctccagactgtcctaaacaccaccctccccgcgcctttgtcccacactgccacctgccgggaatgacctctcctcctttcactcttccccctggctcctcagctgcagccgctccggcctccttgctgttcctgggatacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtggggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagttcaaggctgcattgagctatgattgcaccactatactccagcctgagcaacagagcaagattctgtctcaaaacattataataataaatacattttctaaaaaaagatggggtggagggaggttgcaaattcccccaatggcctggtggagctagggtgacttctgggaactggggtctttcggctcagctgtcacaaggaattaggctctgccctgaggtcccgtgggggccagatggagattagacctgggcattcgcctggttggcccccgcggcgcagcagggggggcggtgggaggagagagaggctggatctgaggtcccagtgacctgccccaggggacagggaccaaggggaggcgggagatggagcaggagctaaaaaccggaagaaaggcccagagattcgaaggggtgaggaggggtggagagaggagagacggggctgggggcacagacacgggcaaaagtgctgctatagggacacagaaatgcccaccctgagggcaagaccctcgcccaactccccaccaatccctaatgcctgccccaccgcaggtgctgtggggtgagggtggtgcgtgggccctgacccctgtgcccacgcacatgtccatgcgtgcgcctgcgcgggcatctgaggcgtggatgccggcagggtgcgtgtgcagcgcctttgggtgtgggccacgagtacgcccatgtgcgcgtctgcgcccgcccctgccagcccacacaatcctcttttcttgtccttacaatgcacaagggtggcctccagcacgagctccacttctgtcctcccaccacttccctctctgcaagcggcgtgaagtccttcctaggactctgggacagagacccgggcgggacccccaaaatccagtgctccaggacttggggtgcggggggcaaagcacgaatggaggaatttcaggcactgcggagggtcagggcccatgggcgggtgcctgtctgccctactgcaaaaagcgagtggccactgactccccaagtccccatgttctaggctcctggtggaatttcaggctggggaccttgtgttctagcccctgtgcaagcagccagcccccgttgcagggaggcagggacagacatcctaaaagatgattcattgttgccaggtgcggtggctcacgcctgtgatcccagcactttgggaggccgaggtgggcggatcacgaggtcaggagatggagaccattctggctaacactgtgaaaccctgtctctactaaaattacaaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaa

SEQ ID NO: 13323 - DNA, 118 bp, Homo sapiens; identical to SEQ ID NO: 8559

SEQ ID NO: 13324 - DNA, 143 bp, Homo sapiens; identical to SEQ ID NO: 7597

SEQ ID NO: 13325 - DNA, 7575 bp, Homo sapiens
gccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcgggtgagttctgcctcgaaggcaggggagccctgcgctctgccccagagagtcggggggcactgccccggggaagagaggccagagctcatgatgcatcctacaattcccaccacaggttccactgagggtgttccacccatccctcgttcccatcaggagagggatccaggaatccctttgcacactcaactttatgaacctttcacctggctgcaaggcccatttactgcatttgttgttgtgattttgtgtgcaagcccttattattcacacatgtactcatcatgcagttcttcatgaaatacgtagggtacccagtctgtgccacagcacgcactttaaaagagtaacaataggacactgacctgcctcgatgcctgcccaggaagtcccacagggcagcccttgccaaagggggagaagggctggtcacaccagggccttctgctaacaaggatgccctggagtacaagtcggctggcacctctgccctgctataatgagtttaagggatttaggggttgatcaaggagaaagatataacctcaaaatggtgttagcacacaaagttttatatcagctgtgcttttttttttttttttttttttttttttggagatgggttttctctctgtcgcccgggctggagtgtggtggcatgatggctcactgcaacctccacctcccaggctctaattgatcctcccaccttagcctcctgagtaactgtgttgacaggtgcataccaatatgcccggctaatttttgtattttttgtagagatggggtttcaccatgttgcccaggctggtctcgaactcctgggctcaaacattcaacctgcctcggcctcccaaagtgttgcgattacaggcatgagccagcgtgcctagcttgcactgcgctttgacaggtttgcatgcaggggaagtccctcacagcatgagaccttccaaaggtgctgggggctactgcccagtgtggaggaaggcaagggaactcctaggggagagctcgggaagagggaccatctaggttaggtagctctgcagcacgatggggagtctctgggtcagagaactccaaagcacagcagcagcttggggtctcttataggcccagggtttatctatctatggctaacaaatgttgggtacagtttcacagggtatgcaaaacaggaaggttgtatatggctttaaaagctgcttatttgagctatatttaaaacaactggaagggtaaaaatttgagtttggcaccagcaggcttttaagccaacaggtcccagactgccatgaagaaataaacaatatgggaccaatatgcaagggccaatataggaccaatataggaccaatatgaaaaatttcataaatttttcatttatgaaaaataatacctgccactctgtgatcgccacccacggcaaaaaagacttttgctagttctctgtgcacacagccagccttgctgagagcaccttacagagggtgcctacctgaactctcaggaccatcagctgaaatctcagtgctgaatacaggtggtgatgccctagggcaggaagatgacgccggacttcttaggcctggactgatatgggagcttcaaactgactctggcagttctaaagttccagaaaagtttatttctttcttatttataccctgtttacttataaacaggattataacaagaacattgaggggaaaacagaaaattggaaggcttgaaggaggagaggaaataaatatatcccaaatctaaagtagcctaattatagttagatattatgtttatctttgagcttcctggtaaccaaggcaaaaagagatcagaaaacaagtgcctatgtgccctaccttaacacttgatcttattcgaaagactgagaagtaatatgtgccctgacttaagaaaaacaaactagaaaacttgacctttcaaatagtaaaaaaaaaaaaaaattagcatctatgacttctaacaaagaaccattgatatgatggctttaggccggacgcggtggctcacgcctgtaatcccagcactttgggaggccgaggcgggcagatcacaaggtcaggagattgagaccatcctttgaatggtgaaaccccgtctctactaaagatacaaaaaattagccgggcatggtggcgggcgcctgtagtcccagctacttgggaggctgaggcaggagaatggcgtgaacccaggaggcggagcttgcagtgagccgagattgcgcccctacactccagcctgggcgacagagcgagactccgtctcaaaacaaacaaacaaaaaaaacgatggctttatttaccaaaattctgtctttgtgcaatgttttcaagtatatggtacgtggatattttagggctgtctgtggtttgttctcaaaagtgtttacatacgtttacattaggaggaaggggcatagtgttatacccaagcctcttaagaactactgcatggcttgggactgagtttccaccacttcttagtagtctgacattaaagaaatttcttactttgctggagcctaagttccctgggtaaaatagaggtaataacatctaccctcctaggtggcctgaggattagaggtagcgcacatttcaacaggcagccctcatctcctcaattcctcagatccacagttattccgtttcctggccccaaaaatctagtcactcaaacagatgatttgagcacttcccattatcgttctgaatgaagtggatcccacatggagcaagagtgagggtgccgtccctacagtagccccctctgttgtgatagcgagttctccttgcccctttctggaggccccctccactgactcagggccttgcttgctttgcccagcagatggaccgagcggagcacaagggtgagcttcagacagacaagatgatgagggcagctgccaaggatgtgcacaggctccgaggccagagctgtaaggaacccccagaagttcagtctttcaggtaagcagagggccccggcagccccccatccctttctcagccaacccacggccttagtcttctgtctgtggtcttactgctctcatcccttgctcacagagcactggctttccctgtaacagatgttcatcctccgccaagccatccctggcgatccatgagctctgcagcgctcttcccttggctgtctttatcagtccccacacaactcgagctaatttgttagatcctcttgtttaatgaatgagccacctgctccagcctttcctcgtagtgttttccttactggtaattgtggagggttggctgaatgataaataaacctaggggtgatggatgctcgctgggcctccctggctctgcctgccacctgctaggatctcagggaggtgctatcttgccatgctggacccgggtgtattctcggagggtcccgaatgccatttggcctgggcctcccatccacagaggccctagcgtttagacttctgatgtcctctcaaacaaggtacacatgtttgtgtatgtgctttaaaaaaaaaaaaattcctttgtggaatataaacatttaaaatgtatatttgtacaactatctttgggcatctcttaactttttaacaaattgagaatctgaaacaaacaaacattagaagtggcccaagggtccttttaaactgagaagcctctgactggatttgaactaagagtcatcgttcatgctaatggtcttttaaagcagtggttctcaaccaggggtgatttctccccttccccctggaacatttggcaatgagcttacgttttgggttgtcataactggaggtcaaggatacagccagcatctagagggtaagaggccaaggacgttgctaaacattctgcagcgaatgtataggacagctcccacgacaaagaattatcctgcccagaatctctgtagagcgaggttgaaaacccctgctctaaagggatggcctctcttatagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccagggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaaagaaaaatgcagactggctggcgcggtggctcatgcttgtaatcccagcactttgggaggctgaggcgggcagatcaactgagatcgggggttcgagaccagcctgatcaacatggagaaacctggtctctactaaaaatacataattagctgggcgtagtggcgcatacctgtaatcccagctacttgggtggccaaggcttgaacccaggaggcggaggttgcggtgagccgagatggcgccattgactccagcctgggcaacaagagcgtaactccatctcaaaaaaataataataataaaaataaaatgcagactgtcaggtcctctctagacccactgaactatcccgcccaccctgggacggtccccagtgccagtgttttacccatgttccctctgtaagtcttatgcacaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttataa

SEQ ID NO: 13326 - DNA, 141 bp, Homo sapiens; identical to SEQ ID NO: 7393

SEQ ID NO: 13327 - DNA, 159 bp, Homo sapiens; identical to SEQ ID NO: 7616

SEQ ID NO: 13328 - DNA, 267 bp, Homo sapiens; identical to SEQ ID NO: 7644

SEQ ID NO: 13329 - DNA, 98 bp, Homo sapiens; identical to SEQ ID NO: 11303

SEQ ID NO: 13330 - DNA, 153 bp, Homo sapiens; identical to SEQ ID NO: 6795

SEQ ID NO: 13331 - DNA, 5755 bp, Homo sapiens
aagaccatcctggctaacacggtgaaaccctgtctctactaaaaatacaaaaaattagctgggtgtggtggcgggcgcctgtagtcccagctactctggaggctgaggcaggagaatcgcttgaacccaggaggcggaggttgcagtgagccgagatcgcgccactacactcagcctgggcgacagagtgagactccgtctcaaaaaaaaaaaaaaaattacttagacatggtggcacattcctttaatcccagctacttgggaggctgaggcaggagaatcacttgaacccaggaggtggaggttacagtgagccgagatcgcaccactgtgctccacactccagcctgggcaacagagtgaaactctgtctcaaaaaaaaaaaaaaaaaaaaaaaaaaggaataaaggggatgggtttgacatctgacaaaatgctgctgctgccatccgcttctgcaaaacctcaagaatgaaatgtccttcccatggcccacacgaggccctgcacgagctgcttcatccccttccaaacctcctctcctctctcttcccctcctcactctgctcagacacacgggcctcctcactgttcctccaacacgccacgtgtggtctgccccagggccttggcacaggccatgcctctgcctggaacacctgcccccagattctcctatggctgacttctcacacttgggtcttagtgcatgcatcacctcctcagggagggccccctgcccacccccagtgaatctagccccattcaggacagtcatctttattatgcactgattgtatactaagcccagagacttcaactgtggtttctttttcatcctccccaataaatccatccatccatccgttcactcagacatgaaattctggaccctccaattcaggatctgggccacccagtgcctagcttttttttttttttttttttttttttgcgacagagtttcattctgtcacccaggctggagtgcagtggtgcaatctcagctcactgcaacctccgcctcccgggttcaagcgattctcctgcctcagcctcccgagtagctgggattacaggtgtgccaccacgcccggctaatttttgtatttgtagtagagacggggtttcaccatattggccagactggtcttgaacacctgacctcaggtgatctgccctcctcagcctcccaaagtgctgggattactacaggcatgagccactgcacccgtcagcctagcttctttgtgttcattcattcattcattcattcattcatcattcagcaaatgtctatgagcgcctactctgagccactgaaccagctgggctggccctgggggagaatcgacttcccctgcaaattcactctcatcagatccccaggctggtctaggatttgtttagatgccctcacgttggggaactcattccttactaagaataaccaccaccaataccaaacagtctcaagtaccaccaatagtgctgagttctcagggtgactacagcatctgctcccaagcccagcccagcccatatggtgtgtgctgtgtcaaagaacctgggttcaaatcccatgtccttttctaacccttggacaagcccctacccattttgtgcctcggtttccctagctgtaaaatggagatagtagtgcctctcttgtgggctcagcaccaggcctgttacacagctggtgcttaataaatgtgtcctgttacttaaggtctgatatgtgtagctcctgtcgtcgccgtccatgggggtgagtggggtggggaaggggtggtttgagtttctgcacatcaggacacgaggcgcggtccatgcaaatgaaatgcaaatcccatgcaaataaatctctgggtggtgcaaggctggaggtacaaggtgcacgcatttggggggcgcctgggaaccccatgaatcgagcccaggcccggaggtgctgacccgcatccagcccggctttcagtgctcggtgtaaatgtttacacctggccggccgccaggctccacgccgccccacactaggcagccaggagggggaatgtaaactcgggctgggggccgcgggacgctcgggaggagcccagacggagtcgagtgtggtgggtgtgtacacgtgagttattaaacaccgactgtatgcagtgaggaggatgccaccaggcactcacagcaccaagtaactggtgcccgaatgggtaaagctcagggcattcctgggggcccactagcgcccctgcaccagccagaggttgaagtgaatagggtaggcagccatggaaggctccctggaggaggcaccctccaaggtgagattgcaaggggagtgagagctaggtacagtgactcacgcctgtaatcccagctctttgggaggccaaagtggaaggatagcttgagcccaggagtttgagaccagcctgggcaacgttgtgagattcccctctctattaaacaaaaacaaaaacaaaaaaaattaaaaattagccaggcatggtggctcatgcctgtagtcagtcctagctacttgggaggctgaggtgggaggatcgcttgagcctaggaggtggaggctgcagtgagctgtgatcacaccactgcactccagcctgggtgacagagcaagaccctgtctcaaaaaaaaagaaagagagagagaaagaaagaaaggaaagaaaggaagagaaaagaaagagagaagaaaaaggaaagaaagagagagagagagaggaggctgggtgcggtggctcatgcctgtaatcccagcactttgggaggccaaggtgggcggatcacttgagttcaggagcttgagaccagcatagctaacagggagaaaccctgtctctattaaaaatacaaaaattagccagtcatgctggcaggtgcctgtaatcccagctactcagggggctgaggccggagaatcgcttgaacccgggaggcagaggttgcagtgagctgagattgcgccactgcactccagcctgagggacaagagtgagactccatctccaaaagaaaaaaagaaaaagagaaagaaaggggagtgggagtggggagggagggaagaagtgttctccatgcaaggacctatctgtgcaaaagcccagagctgggactccatgtccagggcagctctggtccattgctgcccacttctgggcctgcttatccatctggatgggaaacaggctcagagaggggcagagtcaatggaggacaccagcatgtagggaacagtgtcagccccagattcctgcctccagactgtcctaaacaccaccctccccgcgcctttgtcccacactgccacctgccgggaatgacctctcctcctttcactcttccccctggctcctcagctgcagccgctccggcctccttgctgttcctgggatacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtggggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagttcaaggctgcattgagctatgattgcaccactatactccagcctgagcaacagagcaagattctgtctcaaaacattataataataaatacattttctaaaaaaagatggggtggagggaggttgcaaattcccccaatggcctggtggagctagggtgacttctgggaactggggtctttcggctcagctgtcacaaggaattaggctctgccctgaggtcccgtgggggccagatggagattagacctgggcattcgcctggttggcccccgcggcgcagcagggggggcggtgggaggagagagaggctggatctgaggtcccagtgacctgccccaggggacagggaccaaggggaggcgggagatggagcaggagctaaaaaccggaagaaaggcccagagattcgaaggggtgaggaggggtggagagaggagagacggggctgggggcacagacacgggcaaaagtgctgctatagggacacagaaatgcccaccctgagggcaagaccctcgcccaactccccaccaatccctaatgcctgccccaccgcaggtgctgtggggtgagggtggtgcgtgggccctgacccctgtgcccacgcacatgtccatgcgtgcgcctgcgcgggcatctgaggcgtggatgccggcagggtgcgtgtgcagcgcctttgggtgtgggccacgagtacgcccatgtgcgcgtctgcgcccgcccctgccagcccacacaatcctcttttcttgtccttacaatgcacaagggtggcctccagcacgagctccacttctgtcctcccaccacttccctctctgcaagcggcgtgaagtccttcctaggactctgggacagagacccgggcgggacccccaaaatccagtgctccaggacttggggtgcggggggcaaagcacgaatggaggaatttcaggcactgcggagggtcagggcccatgggcgggtgcctgtctgccctactgcaaaaagcgagtggccactgactccccaagtccccatgttctaggctcctggtggaatttcaggctggggaccttgtgttctagcccctgtgcaagcagccagccccgttgcagggaggcagggacagacatcctaaaagatgattcattgttgccaggtgcggtggctcacgcctgtgatcccagcactttgggaggccgaggtgggcggatcacgaggtcaggagatggagaccattctggctaacactgtgaaaccctgtctctactaaaattacaaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaa

SEQ ID NO: 13332 - DNA, 221 bp, Homo sapiens
gtcacgagatcgagaccatcctggctaacacggtgaaaccccgtctctgctaaaaatacaaaaaattagccaggcgtggtggcgggtgcctgtagtcccagctactcgggaggctgaggcaggagaatggcgtaaacctgggaggcagagcttgcagtgagcggagatcgtgccactgcactccagcctgggcgacagagtgagactctgtctcaaaaaaa

SEQ ID NO: 13333 - DNA, 136 bp, Homo sapiens; identical to SEQ ID NO: 6219

SEQ ID NO: 13334 - DNA, 150 bp, Homo sapiens; identical to SEQ ID NO: 7399

SEQ ID NO: 13335 - DNA, 126 bp, Homo sapiens
tcagctactcgggaggctgaggcaggagaatcacttgaacccgggaggcagaggttgcagtgagccaagattgtgccattgcactccagcctggtgacagagcaagactccgtctcaaacaaagaa

SEQ ID NO: 13336 - DNA, 135 bp, Homo sapiens; identical to SEQ ID NO: 7731

SEQ ID NO: 13337 - DNA, 1710 bp, Homo sapiens
aggacgttgctaaacattctgcagcgaatgtataggacagctcccacgacaaagaattatcctgcccagaatctctgtagagcgaggttgaaaacccctgctctaaagggatggcctctcttatagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccagggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaa

SEQ ID NO: 13338 - DNA, 45 bp, Homo sapiens; identical to SEQ ID NO: 6221

SEQ ID NO: 13339 - DNA, 243 bp, Homo sapiens; identical to SEQ ID NO: 10081

SEQ ID NO: 13340 - DNA, 166 bp, Homo sapiens; identical to SEQ ID NO: 7759

SEQ ID NO: 13341 - DNA, 303 bp, Homo sapiens
ggttgggggctgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtg

SEQ ID NO: 13342 - DNA, 1119 bp, Homo sapiens
ctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactgctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttat

SEQ ID NO: 13343 - DNA, 102 bp, Homo sapiens; identical to SEQ ID NO: 6224

SEQ ID NO: 13344 - DNA, 1512 bp, Homo sapiens
ggttaatggaatcacgtggtatgtatctttttgagagaggccttttttactctgtataatatccttgagattcatccatgttgttgtgtgtttcagtagtcatttattcttattgtccggtagtattccatgctatggatgtaccacagtcgtgctctttttgttaatagaactaaagcaactctatggagctaaggtaactgggtacagctgagtagtgatttaaagtttctggagtgttttcagaaataccatctcacctctaacaaggcgatctcaagtcacttatttgggaaaacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagagtcttgtctttttgaatagccttcatagtaacctctgggattcaagggtacctgatatttaagacctttattaaaccttggttcagtggttttcaaacatttttgaatatcagaaccccttttcctaatggactgtttcatagaaccccaaaatgtgtaacaggtaacagcaatagttttgaaagttcaaaatggataatctttacttgtgaggtcggacatgtgaatggtgggcatattcccatgattctaatatgctgtcagaattatgagtgacagacagttgctgacttggagcacttcagtggctcatttgtttttctctatttggttatacaacagtgagacaagcgtgatgcacatggccattgtcagggtgacttttcctgaacagcatgctgtgtagttactttgattaatcagagatgggaggacaagctccgttttgaggtcaacataatactgagctatcctagcaatacaaaattatgtgtggtggcgggcttcattgtcttaacatatggcttggaacatgtttgagtgtgcatctttttttttttaattgtcctaccttaaaaacacacacattttgcagactctctgaagccctgtggactactattagataattgttggttgggcatgctgtaatcccagaattttgggaggcagaggcgggaggattgcttgagcccaggagttcgagaccagccctggaaacatagcaagatcctacctctacaaaaaaattaaaaaattagctgggcatggtgatgcatgccagcagacccaactactccagagactgaagtaggatgatcacttgagcctgggagttcaaggctgcagcgagccctggttattctgttgcactccagcctgggtgacagaatgagaccctgtccccaccctcccccccaaaaaaaagaaaagaaaa

SEQ ID NO: 13345 - DNA, 35 bp, Homo sapiens
gggtgacagagtgagactctgtctcaaaaaaaaaa

SEQ ID NO: 13346 - DNA, 238 bp, Homo sapiens
  misc_feature (7)..(7): n equals a,t,g, or c
gatcacntgaggtcagagttcgagaccagcctggccaacatggtgaaaccccgtctctactaaaaatacaaaaattagctgggcatggtggcgtgtgcctgtaatcgcagctactctggaggctgaagcaggagaatcgcttaaacccaggaggcagaggttgcagtgagccgagatcgcgccactgcactccagcctgggtgacagagcaagactccatctcaaaaaaaaaaaaaaa

SEQ ID NO: 13347 - DNA, 147 bp, Homo sapiens; identical to SEQ ID NO: 9642

SEQ ID NO: 13348 - DNA, 219 bp, Homo sapiens
gagttcgagaccagcctgaccaacatggtgaaaccccatctctactaaaaatacaaaaattagccgggcgtggtggcacgtgcctgtaatcccagctactcaggaggctgaggcaggagaattgcttgagcccgggaggcggaggttgcagtgagctgagatcgcgccactgcactccaacctgggtaacagggcaagactctgtttcaaaaaaaaaaa

SEQ ID NO: 13349 - DNA, 150 bp, Homo sapiens
cctgtaatcccagctactcaggaggctgaggcaggagaattgcttgaaccttggaggcagaggttgcagtgagctgagatcatgccattgcactccagtctgggcgacagagcaagactctatctcaaaaaaaaaaaaaaaaaaaaaaaa

SEQ ID NO: 13350 - DNA, 35 bp, Homo sapiens; identical to SEQ ID NO: 13345

SEQ ID NO: 13351 - DNA, 238 bp, Homo sapiens; identical to SEQ ID NO: 13346
  misc_feature (7)..(7): n equals a,t,g, or c

SEQ ID NO: 13352 - DNA, 147 bp, Homo sapiens; identical to SEQ ID NO: 9642

SEQ ID NO: 13353 - DNA, 219 bp, Homo sapiens; identical to SEQ ID NO: 13348

SEQ ID NO: 13354 - DNA, 150 bp, Homo sapiens; identical to SEQ ID NO: 13349

SEQ ID NO: 13355 - DNA, 2300 bp, Homo sapiens; identical to SEQ ID NO: 10243

SEQ ID NO: 13356 - DNA, 1561 bp, Homo sapiens; identical to SEQ ID NO: 10244

SEQ ID NO: 13357 - DNA, 2296 bp, Homo sapiens; identical to SEQ ID NO: 10245

SEQ ID NO: 13358 - DNA, 299 bp, Homo sapiens; identical to SEQ ID NO: 10246

SEQ ID NO: 13359 - DNA, 415 bp, Homo sapiens; identical to SEQ ID NO: 10247

SEQ ID NO: 13360 - DNA, 415 bp, Homo sapiens; identical to SEQ ID NO: 10247

SEQ ID NO: 13361 - DNA, 300 bp, Homo sapiens; identical to SEQ ID NO: 10249

SEQ ID NO: 13362 - DNA, 2713 bp, Homo sapiens
gtctctgcctggctttggtatcagaatgatgctggcctcataaaatgagttagggaggattccctctttttctattgattggaagagtttcagaaggaatggtaccagttcctccttgtacctctggtagaattcggctgtgaatccatctggtcctggactctttttggttggtaagctattgattatttccacaatttcagctcctgttattggtctattcagagattcaacttcttcctggtttagtcttgggagagtgtatgtgtccaggaatttatccatttcgtctagattttctagtttatttgcgtagaggtgtttgtagtattctctgatggtagtttgtatttctgtggaatcagtggtgatatcccctttatcattttttattgcgtctatttgattcttctctctttttttctttattagtcttgctagcggtctatcaattttgttgaccctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttgcatttgctgaggagagctttacttcccagtatgtggtcaattttggaataggtgtggtgtggtgctgaaaaaaatgtatattctgttgatttggggtggagagttctgtagatgtctattaggtccccttggtgcagagccgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatatttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgtgtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcactcatgaagcttagtttggctggatatgaaattctgggttgaaaattcttttctttaagaatgttgaatattggcccccactctcttctggcttgtagggtttctgccgacagatccgctgttagtctgatgggcttccctttgagggtaacccgacctttctctctggctgcccttaacattttttccttcatttcaactttggtgaatctgacaattatgtgtcttggagttgctcttttcgaggagtatctttgtggcgttctctgtatttcctgaatctgaacgttggcctgccttgctatattggggaagttctcctggataatatcccgcagagtgttttccaacttggttccattctccccgtcactttcaggtacaccaatcagacgtagatttggtcttttcacatagtcccatatttcttggaggctttgctcatttctttttattcttttttctgtaaacttcccttctcgcttcatttcattcatttcatcttccattgctgataccctttcttccagttcatcgcttcggctcctgagccttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggaactgcgttcctttggaggaggagaggcgctctgctttttagagtttccagtttttctgttctgttttttccccatctttgtggttttatctactttggtctttgatgatggtgatgtacagatgggtttttggtgggga

SEQ ID NO: 13363 - DNA, 4532 bp, Homo sapiens
gtctaacgtttaagtctttaatgcctcttgaattaatttttgtataaggtgtaaggaagggatccagtttcagctttctacatatggctagccagttttcccagcaccatttattaaatagggaatcctttccccattgcttgtttttctcaggtttgtcaaagatcggatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcaggctcttttttggttccatatgaactttaaggtagttttttccaattctgtgaagaaagtcattggtagcttgatggggatggcattgaatctgtaaattaccttgggcattatggccattttcacgatattgattcttcctacctatgagcatggaatgttcttccatttgtttgtatcctcttttatttcattgagcagtggtttgtagttctccttgaagaagtccttcacatcccttgtaagttggattcctaggtattttattctctttgaagcaattgtgaatgggagttcactcattgtttggctccctgtttgtctgttattggtgtataagaatgcttgtgatttttgcacattgattttgtatcctgagactttgctgaagttgcttatcagcttaaggagatttggggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttttgccagttttcaaagggaatgcttccagtttttgcccattcagtatgatatttgctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttgattctgtttatatgctggattacatttattgatttgcatatattgaaccagccttgcatcccagggatgaagcccacttgatcatggtggataagctttttgatgtactgctggattcagtttgccagtattttattgaggatttttgcatcaatgttcatcaaggatattggtctaaaattctcttttttggttgtgtctctgcccagctttggtatcaggatgatgctggcctcattaaatgagttagggaggattccgtctttttctattgattggaatagtttcagaaggaatggtaccagttcctccttgtacctctggtagaattcggctgtgagtccatctggtcctggcctctttttggttggtaagctattgatcattgccacaattttagagcctgttattggtctattcagagattcaacttcttcctggtttagtcttgggagggtgtatgtgtcgaggaatttacccatttcttctagattttctagtttatttgcgtagaggtgtttgtagtattctctgatggttgtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattcattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctgctttctcttctgggcatttagtgctataaatttccctctacacactgctttgaatgcatcccagagattctggtatgttgtgtctttgttctcgttggtttcaaggaacatctttatttctgccttcatttcgtcatgtacccagtagtcattcaggagaaggtttttcagtttccatgtagttgatcggttttgagtgagtttcttaaacctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattactgggtatccttgttaactttctgtctcgttgatctgtctaatgttgacagtgggttgttaaagtctcccattattattgtgtgggagtctaagtctctttgtaggtcactcaggacttgctttatgaatctgggtgctcctgtattgggtgcgtatatatttaggatagttagctcttcttgttgaattgatccctttaccattatgtaatggccttctttgtctcttttgatctttgttagtttaaagtctgttttatcagagactaggaatgcaacccctgcctttttttgttttccatttgcttggtagaccttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagcggctggtaccagttgttcctttccatgtttagtgcgtccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgattggcttccctttgtggttaacccgacctttctctctggctgcccttaacattttttcctttatttcaactttggtgaatctgccaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccacgtcactttcaagtacaccaatcagatgtagatttggtcttttcgcatagtcctatatttcttggaggctttattagtttctttttattcttttttctctaaacttcccttctcgcttcatttcattcatttcatcttccatcactgataccctttcttccagttgatcgcatgggctcctgaggcttctgcgttcttcacgtagttctcgagccttggctttcagctccatcagctcctttaagcacctctctgtattggttattctagttatacattcgtctaaatttttttcaaagttttcaacttctttgcctttggtttgaatttcctcctgtagcttggagtagttttatcgtctgaagccttcttctctcaactcatcagtcattctccgtccagctttgttccgttgctggtaaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgctggagtttgctagaggtccactccagaccctgtttgcctgggtactagcagcggtggctgcagaacagtggattttcgtgaaccatcaatgctgctgtctgatcgttcctctggaagttttgtctcagaggagtacccagccgtgtgaggtgtcagtctgcctttactggggggtgcctcccagttaggctgctcagtggtcaggggtcagggacccacttgaggaggcagtctgcctgttctcagatctccagctgcgtgctgggagaaccactgctctcttcaaagctgtcagacagggacatttaagtctgcagaggttactgctgtctgtttgtttgtctgtgcctgcccccagaggtggagcctacagagccgtcatgcctccttgagctgtgtggctccacccagttgagctt

SEQ ID NO: 13364 - DNA, 1287 bp, Homo sapiens
cttttgatctttgttggtttaaagtctgttttatcagagactaggattgcaacccctgcctttttttgtttcccatttgcttggtagatcttcctgcatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgattattttgctcgttagttgatgcagtttcttcctagccttgatggtctttacaatttggcatgattttgcagtggctgttaccagttgttcctttccatgtttagcgcttccttcaggagctcttttaggtcaggcctggtggtgacaaaatctctcagcatttgcttgtctgtaaagtattttatttctccttcacttttgaagcttagttcggctggatatgacattctgggttgaaaattcttttctttaagaatgttgaatattggcctccactctcttctggcttgtagagtttctgctgagagatctgctgttagtctgatgggcttccctttgtgggtaacccgacctttctctctggctgcccttaatattttttccttcatttcaactttggtgaatctgacaattgtgtgtcttggagttgctcttctcgaggagtatctttgtggcgttctctgtatttcctgaatctgaatgttggcccaccttgctagattggggaagttctcctggatagtatcctgcagaatgttttccaacttggttccattctccccatcactttcaggtacaccaatcagacgtagatttggtcttttcacatagtcccatatttcttggaggctttgttcatttctttttatttttttttctctaaacttcccttctcacttcatttcattcatttcatcctccatcactgataccctgtcttccagttgatcgcatcggctcctgaggcttctgcattcttcacgtagttcttgagccttggctttcagctccatcagctcctttaagcactgctctgtattggttattctagtcatacattcgtctaaattttttttcaaagttttcaacttccttgcctttggtttgaatttcctcctatagctcggagtagtttgatcgtctgaagccttcttctctcaactcatcaaagtcattctctgtccagctttgttccattgctggtgaggagctgcgttc

SEQ ID NO: 13365 - DNA, 4529 bp, Homo sapiens
gtctaacgtttaagtctttaatccatctcgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaacttgaaaatagttatttccaattctgtgaagaaagtcattggtagcttgttggggatggcactgaatctgtaaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaagttggattcctaggtatcttgttctctttgaagcaattgtgaatgggagttcactcatgatttggctctctgtttgtctgttattggtatataagaatcttgtgatttttgtacattgattttgtaacctgagactttgctgatgttgcttatcagcttaaggagattttgggctgagacaatggggttttctagatatacaatcatgtcactgcaaacagggacaatttgacttcctcttttcctaattgaataccctttatttccttctcctgcctaatggccctggccagaagttccaacactctgttgaataggagtggtgaaagagggcatccctgtcttgtgccagttttcaaagggaatgcttccagtttttgctcattcagtatgatattggctgtgggtttgtcatagatagctctcattattttgagatacgtcccatcaatacctaatttattgagagtttttagcatgaagggttgttgaattttgtcaaaggccttttctgcatctgttgagataatcatgtggtttttctctttggttctgtttatatgctggattacatttattgatttgcatatattgaaccagccttgcatcccagggatgaagcccacttgatcatggtggataagctttttgatgtgctgctggattcgatttgccagtattttattgaggatttttgcatcaatgttcatcaaggatattggtttaaaattctctttttttggttgtgtctgtgcccggctttggtatcagaatgatgctggcctcacaaaatgagttagggaggattccctctttttctattgattggaatagtttcagaaggaatggtaccagttcctccttgtacctctggtagaattcggctgtgaatccatctggttctggactctttttggttggtaagctattgattatgccacaatttcagagcctgttattggtctattcagagattcaacttcttcctggtttagtcttgggagggtgtatgtgttgaggaatttatccatttcttctagattttctagtttgtttgcgtagaggtgtttgtagtattctctgatggtagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattaattttttgaagggttttttgtgtctctatttccttcagttctgctctgattttagttatttcttgccttctgctagctttcgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaggtatgtggtcaattttggaataggtgtggtgtggtggtgaaaaaaatgtatattctgttgatatggggtggagagttctgtagatgtctattaggtctgcttggtgcagagctgagttcaattcctggatatccttgttgactttctgtctctttgatctgtctaatgttgacagtggggtgttaaaatctcccattattattgtgtgggagtctaagtctctttgtaggtcactcaggacttgctttatgaatctgggtgctcctgtattgggtgcatatatatttaggatagttagctcttcttgttgaattgatccctttgccgttatgtaatgtccttctttgtctcttctgatctttgttggtttaaagtctgttttatcagagtctaggattgcaacccctgccttttttagttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttggtgcagtttcttcctagccttgatggtctttacaatttggcctgattttgcagtggctggtaccagttgttcctttccatgtttagtgcttccttcaggagctctttcggggcaggcctggtggtgacaaaatctctcagcatttgcttgtctgtaaagtattttatttctccttcacttatgaagcttagtttggctgggtatgaaattctgggttgaacattcttttctttaagaatgttgaatattggctcccactctcttctggcttatagagtttctactgagagatccactgttagtctgacgggcttccctttgtgggtaacctgacctttctctctggctgcccttaacattttttccttcatttcaactttggtgaatctgacaattatgtgtcttggagttgctcttctcgaggagtatctttgtggcgttctctgtatttccatgaattctgaacgttggcctgccttgctagattggggaagttctcctggataatatcctgcagagtgttttccaacttggttccattctccccgtcactttcaggtacacgagtcagacgcagatttggtcttttcacatagtcccatatttcctggaggctttgttcatttctttttattctttcttctctaaacttcccttctcacttcatttcattcatttcatcttccatcactgataccctttcttccagttgatcgcattggcttctgaggcttctgcattcttcacgtagttctcgagccttggttttcagctccatcagctcctttaagcacttctctgtattggttattctagttatacattagtctaaatttttttcaaagttttcaacttctttgcctttggtttgaatttcctcctgtagctcagagtagtttgatcgtctgaagccttcttctctcaactcgtcaaagtcattctccgtccagctttgttccattgctggtgaggagctgcattcctttggaggaggagaggcactctgctttttagagtttccagtttttctgctctgttttttccccatctttgtggttttatctacttttggtctttgatgatggtgttgtacagatgggtttttggtgtggatgtcctttctgtttgttagttttccttctaacagacaggaccctcagctgcaggtctgttggagtttgctagaggtccactccagaccctgtttgcctggatgtcaccagcggtggctgcagaacagtcgattttcgtgaactgtgaatgctgctgtttgatcgtttctctggaagttttgtctcagaggagtacccggtcatgtgaggtgtcagactgtccctactggggtgtgcctcccaggtaggctgctctggggtcaggggtcagggacccagttgaggaggcagtctccctgttctcagatctccatctgcgtgctgggagaaccactgctctcttcaaagctgtcagacagggacatttaagtctgcagaggttactgctgtctttttgtttgactgtgccctgccgccagaggtgcagcccacagccgcaagcacgccttcttgagctgtggagggctccaccca

SEQ ID NO: 13366 - DNA, 2229 bp, Homo sapiens
ccttcatttcgttacgtacttaatagtcattcaggagcaggttgttcagtttccatgtagttgagcaggggtgatttagtttcttaatcctgagttctagtttgattgcactgtggtctgagagacggttgttataatttctgttcttttacatttgctgagaagagctttacttccaactatgtggtcaattttggaataggtgtggtgtggtgctgaaaaaaatgtatattctgttgatttggggtggagagttctgtagatgtctattaggtctacttggtgcagagctgagttcaattcctgggtatccttgttaactttctgtctcgttgatctgtctaatgttgacagtggggtgttaaagtctctcattattattgtgtgggagtctaagtctctttgtaggtcactcaggacttgctttatgaatgtgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccttgcctttttttgttttccatttgcttggtagatcttcctccatccttttattttgagcctatgtgtgtccctgcacgtgagatgggtttcctgaatacagcacactgatgggtcttgactctttatccaatttgccagtctgtgtcttttaattggagcatttagcccatttacatttaaggttaatattgttatgtgtgaacttgatcccgtcattatgatgttagctggttattttgctcattagttgatgcagtttcttcctagcctcaatggtctttacaatttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttgtagagtttctgccaacagatccgctgttagtctgatgggcttccctttgtgggtaacctgacctttctctgtggctgcccttaacattttttccttcatttcaactttggtgaatctgacaattatgtgtcttggagctgctcttctcaaggagtatctttgtggcattctctgtatttcctgaatctgaatgttagcctgccttgctagattggggaagttctcctggatgatatcctgcagagtgttttccaacttggttccattctccctgtcactttcaggtacaccaatcagacgtagatttggtctctttcacatagtcccatatttcttggaggctttgtttgtttctttttattcttttttctctaaacttcccttctcacttcattttgttcatttcatcttccatcactgatactccttcttccagttgatcacatcggctcctgaggcttctgcattcttcacgtagttctcgagccttggctttcagctccatcagctcctttaagcacttctctgtattggttattctagttatatattcgtctaaatttttttcaaagtttttaacttctttgcctttggtttgaatttcctcctgtagctcggagtagtttgatcgtctgaagccttcttctctcaactcgtcaaagtcattctccgtccagctttgttccattgctggtgaggaactgcgttcctttggagtaggagaggcactctgctttttagagtttccagtttttctgctctgttttttccccatctttgtggttttatctacttttggtctttgacgatggtgatgtacagatgggtttctggtgtggatgtcctttctgtttgttagttttccttctaacagacaggaccctcagctgcagatctgttgaagtttgctagaggtccactccagaccctgtttgcctgggtatcagcagcggtggctgcagaacagcggattttcatgaaccacgaatgctgctgtctgatcgttcctctggaagttttgtctcataggagtacccggcagtgtgaggtgtcagtctgcccctactagggggtgcctcccagttaggctgctcgggggtcaagggtcatggacccacttga

SEQ ID NO: 13367 - DNA, 617 bp, Homo sapiens
tattgattattctagttatactttcatctaaatttttttcaaagtttttaacttcttccccttcggtttgaatttcctcctgtagcttggagtagtttgatcgtctgaagccttcttctctcaactcgtcaaagtcattctcagtccagctttgttccgttgctggtgaggaactgtgttcctttggaggaggagaggtgctctgctttttagagtttccagtttttctgctctgttttttccccgtctttgtggttttatctacttttggtctttgatgatggtgatgtacagacgggtttttggtgtggatgtcctttctgtttgttagttttccttctaacagacaggactctcagctgcaggtctgttggagtttgctagaggtccactccagaccctgtttgcctgggtaacagcagcggtggctgcagaacagcggattttcgtgaaccgcgaatgctgctgtctgatcgttcctctggaagttttgtctcagaggactacccggccgtgtgagatgtcagttggcccctactgtgggggtgcctcccagttacgctgctcaggggtcaggggtgacggacccacttgagaaggcagtctgcccgttctca

SEQ ID NO: 13368 - DNA, 3982 bp, Homo sapiens
gtctaacgtttaagtctttaatccatcttgaattgatttttgtataaggtgtaaggaagggatccagtttcagctttctacatatggctagccagttttcccagcaccatttattaaatagggaatcctttccccattgcttatttttctcaggtttttcaaagatcagatagttgtacatatgcggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcccatcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacatcatgttgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgagtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgcccgtattttattgaggatttttgcatcaatgttcatcaaggatattggtctaaaattctctttttttcttgtgtccctgcctggctttggtatcagaatgatgctggcctcataaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcagctcctgttattggtctcttcagagattcaacttcttcctggtttagtcttgggagggtgtatgtgtccaggaatttatcaatttcttctagattttcgagtttatttgcgtagaggtgtttgtagtattctctgatggtagtttgcatttctgtgggttcggtggtgatatcccctttatccttttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtaccccgtagtcattcaggagcaggttgttcagttttcatgtagttgagcggttttgagtgagattcttaattctgagttctagtttgattgcactgtggtctgagagattgttataatttctgttcttttacatctgctgaggagagctttacttcccagtatgtggtcaattttggaataggtgtggtgtggtgctgaaaaaaaatgtatattctgttgatttggggtggagagttctgtagatgtctattaggtccgcttggtgcagagctgagttcaagtcctgggtatccttgttgactttctgtctcattgatctgtctaatgttgacagtggggtgttaaagtctcccattattaatgtgtgggagtctaagtctctttgcaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcaagtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagtgcttccttcaggagctcttgtaaggcaggcctggtggtgacaaaatctctcagcatttgcttgtctgtaaaggattttatttctccttcacttatgaagcttagtttggctggatgtgaaattctgggttgacaattcttttctttaagaatgttgaatattggcccccactctcttctggcttgtggggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctctgtggcgttctctgtatttcctgaatctgaacgttggcctgccttgctagattggggaagttttcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctctcttcatttcattcatttcaccttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgctttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttcccgtttttctgttctgttttttc

SEQ ID NO: 13369 - DNA, 914 bp, Homo sapiens
agtccccagagtgtgatgttccccttcctgtgtccatgtattctcattgttcagttcccacctatgagtgagaatatggggtgtttggttttttgttcttgcggtagtttactgagaatgatgatttccaatttcatccatgtccctacaaaggacatgaactcataattttttatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagccctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcattcctctgatgaccagtgatgatgagcattttgttgtgtgttttttggctgcataaatgtcttcttttgagaagtatctgttcgtgtccttcgtccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcc

SEQ ID NO: 13370 - DNA, 1085 bp, Homo sapiens
ttttattttattttattattatactttaagatttagggtacatgtgcacaatgtgcaggttagttacatatgtatacatgtgccatgctggtgtgctgcacccattaactcgtcaattagcattaggtgtatctcctaatgctatccctccccctccccccaccacacaacagtccccagagtgtgatgttccccttcctgtgtccaagtgttctcattgttcaattcccacctatgagtgagaacacgcggtgtttggttttttgtccttgcgatagtttactgagaatgatggtttccaatttcatccgtgtccctataaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttggatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagatcctggatattagccctttgtcagatgagtaggttgcgaaaattttctcccattttgtaggttgcctgttcactctggtggtcatttcttttgctgtgtagaagctctttagtttaattagatcccatttgtcaattttggcttctgttgccattgcttttggtgttttagacatgaagtccttgcccatgcc

SEQ ID NO: 13371 - DNA, 1552 bp, Homo sapiens
gctttgaatgtgtcccagagattctggtatgttgtgtctttgttctcgttggtttcaaagaacatctttatttctgccttcatttcgttaggtacccagtagtcattcagaagcaggttgttcagtttccatgtagttgaatgcttttgagtgagtttcttaatcctgagttctagtttgattgcactgtggtctgagagactgttataatttctgttcttttacttttgttgaggagagctttacttccaagtatgtggtcaattttggaataggtatggtgtggtgctgaaaaaaatgtatattctattgatttggggtggagagttccgtagatgtctattacgtccgcttggtgcagagctgagttcaattcctgggtatccttgttaactttctgtctcgttgatctgtctaatgttgacagtggggtgttaaagtctcccattattactgcgtgggagtctaagtctctttgtaggtcactcaggacttgctttatgaatttgggtgctcctgtattaggtgcatatatatttaggatagttagctcttcttgttgaattgatccctttaccattatgtaatggccttctttgtctcttttgacctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttttagggcaggtctggtggtgacaaaatctctcagcatttgcttgtctgtaaaggattttatttctccttcacttatgaagcttagtttggctggatatgaaattctgggttgaaaattcttttctttaagaatgttgaatattggtccccactcccttgtggcttgtagagtttctgccgagagatccgctattagtctgatgggcttccctttgtgggtaacccgacctttctctctggctgcccttaacattttttccttcatttcaacattggtgaatctgacaattatgtgtcttggagttgctcttcttgaggagtatctttatggcgttccctgtatttcctgaatctgaatgttggcctgccttgctagattggggaacttctcctggataatatcctacagagtgtttttcaacttggttccattctccccgtcactttcaggtacaccattcagacatagatttggtcttttcacatagtcccatatttcttggaggctttgttcatttctttttattcttttttctct

SEQ ID NO: 13372 - DNA, 914 bp, Homo sapiens
agtccccagagtgtgatattccccctcctgtgaccatgtgatctcattgttcagttcccacctatgagtgagaatatgcagtgtttggttttttgttcttgcgatagtttactgagaatgatgatttccaatttcattcatgtccctacagaggacatgaacgcatcattttttatggctgcatagtattccatggtgtatatgtgccacattttcttaatccagtctgtcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattctgtaggttgcctgttcactctgatgatagtttcttttgctgtgcagaagctctttagtttaattagatcccatttgtcaattttgtcttttgttgccattgcttttggtgttttggacatgaagtccttgcccatgcc

SEQ ID NO: 13373 - DNA, 5633 bp, Homo sapiens
gtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagggggaatctggagagtctgagctttgagcttgtcttagaaaataagactgtccacctggggaggggagcttatagggaaccccgtgttaactcagaatgctgaagaaagtgcttttagccaacaaaagaagattactatgtagaaggtggaaagaagtcattgcttctggttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcatagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaagtatgacctctaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacat

SEQ ID NO: 13374 - DNA, 13862 bp, Homo sapiens; identical to SEQ ID NO: 9647

SEQ ID NO: 13375 - DNA, 3502 bp, Homo sapiens
ttgtaatgatttgggcacactactggagctgaggctagcagtcacatgatttggctgtctctgacctgaagcttttgaagtaggttaatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacat

SEQ ID NO: 13376 - DNA, 3544 bp, Homo sapiens
tatatgaagactcttttctttgcataaaaagcattaggcgtataaatgtataaatatattttattatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtataattttttaaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgggtggggatgcattgcagaggcagtagtagcatgggggctagagtggggagcgagatggaaaagggtggggggataggagaattctagagtgcttccagcatgagggtcctgagaacttctgtcctgagttcagagaaacatgcaaagtaactaacaaaatcgctacttgcctttgcagttttacagacccagggagctgctttgggagtgagaaaggcaaccctccaatgtgtttcaactttaaaatgttgaattcttttcagacatgtggtatctcatttattctccttttctagcgtttgttgaatttcaggcagaatgtcttacagaatgtcctagaaccagattatcatttaatccgaaacagctgaggaagggacagagaaggtacaagggcaaggcagcataaaacagatcaggagaatgaagagggaatgctttggttttttgttctgttttgttttttctttttcaagtaactaaaacagcatctacatgtagagtgtcgtggagagctgagaccagggtaaagtcaagtgcagcatcagtactgcgagacccaccagcccctggagagggtcagctgagaatctggtagtgaagcctgtgtagggtcccggcaccctcaccctcagccacctgcagagaggccagggccccagagactagcccggttctgaagtgggcaggggtgctgccagagccttccgccccttatattgagaccctgctttcaggacaggccagccgttggccaccatgtcacattctgagtgagtgtcacgggtccctaacaataattttctgatctggagcatatcagcagaatgcttagcctcaaggggcctggcagctgtaatgtttgatttatgatgagaactatccgaggccacacttggcctctaaataagctgctctagggagccgcctactttttggtgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaaatgtgaatgaatctgagcttggtttcctttattgcttcctctgcaatatgattgctgaaacacattttaaaaattcagaagtttgtcactcctgttaatgggaggatcattcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttatacgcagtttaaagatggtggggacagactttgcctctacctagtgaaccccacttaaagaataaggagcatttgaatctcttggaaaaggccatgaagaataaagcagtcaaaaagaagtcctccatgttggtgccaagggcttgcgaggggaaataaaaatgttatccagcctgaccaacatggagaaaccccgtctctattaaaaatacaaaattagcctggcatggtggtgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctcaaagcaaaaaagaaaccctaacagctctgaactctggttttatttttcttgctgtatttgggtgaacattgtacgattaggtataatttaaaaaaaaaaattttttttttggtagaaatgcaatcaccagtaaagaggtacgaaaaagctagcctctctcagagactggggaggcagagtactactagaggaagtgaagttctgatggaatcatgcctgtcaaatgaggtcttgaagcggatgcccaaataaaagagtatattatattttatctaaatcttaagtgggtaacattttatgcagtttaaatgaatggaatattttcctcttctttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaactgtattgtgcattttggcttcacatgtttaactttttttaagaaaaaagttgcatgaatggaaaaaaaatctgtatacagtatctgtaaaaactgtcttatctgtttcaattccttgctcatatcccatataatctagaactaaatatggtgcgtggccatatttaaacacctgagagtcaagcagttcagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttactttccttggtgtttgtagatattgccttgtgtattccacttaaaaccgtaatctagtttgtaaaagagatggtgacgcatgtaaataaagcatcagtgacactctaaaaaaaaaaaaaaaaaaaaaagaa

SEQ ID NO: 13377 - DNA, 397 bp, Homo sapiens
ccttgatacaacaggttcactttgttcatttttgagaaactgtctgccagatacccaagttagataacatagtttgccattcagtcatcctttcaggtaaaatggtggtctgtgaaacaagtggctggttcagctcacaactcaaatgattgcatggtatatttcctcaagacgaccattgttctttggtataaacagaattgctttgcgaatatttcctatttcattaaccctgaatattaaaaaggcacttcaaggattaaaattcaatgaaattaatgtttatgcttccttagacatttttaaataaaactggcttttttttttttaaaccaagagtacatgatggggaagaatacaaggactactagtaagtttagtatcattgtgttgattt

SEQ ID NO: 13378 - DNA, 319 bp, Homo sapiens; identical to SEQ ID NO: 7553

SEQ ID NO: 13379 - DNA, 109 bp, Homo sapiens; identical to SEQ ID NO: 7566

SEQ ID NO: 13380 - DNA, 184 bp, Homo sapiens; identical to SEQ ID NO: 7572

SEQ ID NO: 13381 - DNA, 147 bp, Homo sapiens; identical to SEQ ID NO: 6794

SEQ ID NO: 13382 - DNA, 170 bp, Homo sapiens; identical to SEQ ID NO: 7598

SEQ ID NO: 13383 - DNA, 98 bp, Homo sapiens; identical to SEQ ID NO: 7600

SEQ ID NO: 13384 - DNA, 4344 bp, Homo sapiens
tgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtatgtacacacttaaaccttcaatgttctgattgtgatatggggtagtaattctttccagtttgtaatgtgtattctgttttcttttgtcttaaataattttttgcattttcataattaacaatatagtctttttactctcaaagttgtgtcaatttttattctcatcaaactatataaaactcaagtttaatgcttcatataattattttaatcatgcttttctgtctgttactttatattttgtagaatttacctgaatggttgatatgtcttactaaatttttaaaattttaattgaacttcttacaggttaacctgtatttttttaatagatgtaagtataggtatgtacttctttgctaatttccacaaatgtttcatggaataatatgaataatgacgccaactgtaatttacataagtagaatgaggatagatagaactgactgctttagggcagcctcacaaatcatagcaatttattctatttatacagggtagacagttgttcatcctgacagtgaaacactgctgataagttactttatttcctctatacctcttgataggaaagaggctgctttttgagagttcaggaagttgtagatttggtgcgtatttcatagttcctctaaaagtagtaaaatgactgaggacaagtgtatacctaactaggcagctatatgtccaaacgtatgtcatgttaaagaggacagcttttcttctttttctaacgtgaatctagccacctttgaatatccttaattcagattggcattggcctgtttccagggatttggattagcctgggattttctgtagtttcagattgtacaagttctgatagatttccttcttaccttttagggtttatgcgattcattgggcccaggctacccttaacctttccatttcagatcaggtcactgttgctatagaaaaccagacagaattcctgcttgggacaagagtaggaagaggcaagactgaatgagtggtcctctgcatggacaccactcactcctgaggctgctggcagcatgtaccctcatcctgcctcactccttagcagctagtgtgaacgtgaagaattgagaaatatagtgatcacatcagtgtgtattcattctggtcagcaaactaggcatatcttaagttttttaggaaatcactgttggcctccttttgtgtatcatagtgcaaaacagttttaattagttgaattattatagatacacaagaatttagaaaatgcgtctgggcgtggtagctcacacctgtagtcccggcactttgggagtccaaggcgaatggatctgcttaagtccaggagtttgagaccagcctgggcaacatggtgaaaccctgtgtctacaaaaactaccgtgtctacaaaaaaattagccaatcatggtgttgcatgtctatggttccaactactttgagaggctgtggttggaaagatcacttgagcccaggagttagaggttgcagtgagccgagatcacaccactgcactccagcatgggccaaaaaaaaatgagactcttgtttaaagaaaaaaaaaaagagtttagaaatggccattacgggccgggcgtggtggctcacgcctgtaatcccagcactttgggaggctgaggtgggtggatcatgaggtcaggagatcgagaccatcctggctaatacggtcaaaccccgcctctactaaaaatacaaaaaatcagctgggcgtggtggcaggtgcctgtagtcccaactactcgtgaggctgaggcgggagaatggtgtgaacccgggaggcagagcttgcagtgagccgagattgcgtcactgcactccagcctgggcgacagagcgagactccatctcaaaaaaaaaaaaaaagaaaaaggaaaatggccattactttggttacactttaccaagcatagataaatatagagggctaggttgggaaaacccagtgtgtgaagatgacatagccttacattgaatgttattgggccagaatggtgcagaaagagagccagcaatgagaaatgggagagcacagagcagtgccccatctcagatacaatcagtgactttcccagcagcagagccttaagatacaggaaagaaaaactgacaaaattgaagggaaaaatcaacaattcagcaataatttggagactttgatacgccacttttaataatggatagaacagcttaagactataaaccaatgaggcctaacagacatctatagaacctcatcagaatacgcattcatctcaagtgcaagtgcagcattccaggatagaacatatgctagaccgtataacaagcttccataaacttcaaaggattgaaatcataaaaggtatgttctgtgaccccaatggaggaaaattagaaattaacaaggaaatttgggaatttcacaaatacatagaaatgaaataacacacttctaaataatcagtgggtcaaagaagaaatcaaaaaggaaatcagaaaacattttgaagtgaattaaaagaaagataaaacatactaaaacttacaggatgcagccaaagcggtggtttagagggaaatttatacttgtaaatgcctgcgtgaaaaaaagaagactgggcgtggtggctcacgcctgtaatcccagcagtttgggaggctgaggcaggaggatggcttgagctcaggagttcaagaccagcctggacaatatggcgagaccccacttttacaaaaaaatacaaaaattaaccaggtttgatgatgcatgcctgtggtcccagctactagggaggctgaggcaggatgattccttgagcccaggaattcgaggctgcggtgagctgtgatcatgccactgcactccaggctgggtggcaaagcaagaccctgtcttcaaaaaaaaaaaaagtgagttgtgtcgtatgtgaattgtatttcaataaagctattatgctgttaccaaaaatttaacaatgttgatagcttttcacatacctacatgcaactaatttgattgcaaaatcatatgtctacccttggcaggaacttacatttaagtatttgttctgtgaaagagtggatgaaaaggttaaactttactctgtgtttcattcttccccattttggttttgagagcctgaaagttacattgctgttgtcctccataaatgatgtgctgattccatggaaggactgtcagtggcatatacatcaaacttaatcagctctgatgaaacttcttacaaacttggccttcatttccttctttacattgcttttcttccacagttaaacccagttatttcagttatatatttcagtctgtatttttatccattcgttcataattgcttcaaacagaggtcagtagaaataggtctgtcattctctctccacttctttccccacttctactgcccagctctggaattgtgggcaagtttctttttgtctgggcctcagttgcctgcaaagtggggataataatcattcacctgccctaaagcaggaagctgaacttcatgagattccttttgatacttgagatctggagttctggcgcttcttgcagaaactatcttgtgttcctctttccttttcagtcgagtcctatctgtaatggccctgtgtattgtcttgttaaaatagtgaacatgctcccgtcccgtttctcagtgttccttggagagaagggggtgggggagagtcaagcatttgaaccaaattctcacgactacccagaccccattcttgggaacctgctattactacctgctaacgataatactctcagtaatggagatagtttactgcatttggttttctgtcttatgcaaaggttattaaattcttaattactaaaatgattgatttttcagttctttattaccagcttgaatgggcaatgccgctaaagattttaaggcagatttaagtagttttcaatttgagtaatttttcttgcttttgcttttcacaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactaggtaattttcagtctttatcctgaatggaacagatgattatgtt

SEQ ID NO: 13385 - DNA, 125 bp, Homo sapiens; identical to SEQ ID NO: 7605

SEQ ID NO: 13386 - DNA, 108 bp, Homo sapiens; identical to SEQ ID NO: 11444

SEQ ID NO: 13387 - DNA, 175 bp, Homo sapiens; identical to SEQ ID NO: 7613

SEQ ID NO: 13388 - DNA, 101 bp, Homo sapiens; identical to SEQ ID NO: 6685

SEQ ID NO: 13389 - DNA, 162 bp, Homo sapiens; identical to SEQ ID NO: 6214

SEQ ID NO: 13390 - DNA, 129 bp, Homo sapiens; identical to SEQ ID NO: 7645

SEQ ID NO: 13391 - DNA, 193 bp, Homo sapiens; identical to SEQ ID NO: 7396

SEQ ID NO: 13392 - DNA, 140 bp, Homo sapiens; identical to SEQ ID NO: 6216

SEQ ID NO: 13393 - DNA, 187 bp, Homo sapiens; identical to SEQ ID NO: 7657

SEQ ID NO: 13394 - DNA, 114 bp, Homo sapiens; identical to SEQ ID NO: 6217

SEQ ID NO: 13395 - DNA, 153 bp, Homo sapiens; identical to SEQ ID NO: 6795

SEQ ID NO: 13396 - DNA, 202 bp, Homo sapiens; identical to SEQ ID NO: 7667

SEQ ID NO: 13397 - DNA, 16284 bp, Homo sapiens
tgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtatgtacacacttaaaccttcaatgttctgattgtgatatggggtagtaattctttccagtttgtaatgtgtattctgttttcttttgtcttaaataattttttgcattttcataattaacaatatagtctttttactctcaaagttgtgtcaatttttattctcatcaaactatataaaactcaagtttaatgcttcatataattattttaatcatgcttttctgtctgttactttatattttgtagaatttacctgaatggttgatatgtcttactaaatttttaaaattttaattgaacttcttacaggttaacctgtatttttttaatagatgtaagtataggtatgtacttctttgctaatttccacaaatgtttcatggaataatatgaataatgacgccaactgtaatttacataagtagaatgaggatagatagaactgactgctttagggcagcctcacaaatcatagcaatttattctatttatacagggtagacagttgttcatcctgacagtgaaacactgctgataagttactttatttcctctatacctcttgataggaaagaggctgctttttgagagttcaggaagttgtagatttggtgcgtatttcatagttcctctaaaagtagtaaaatgactgaggacaagtgtatacctaactaggcagctatatgtccaaacgtatgtcatgttaaagaggacagcttttcttctttttctaacgtgaatctagccacctttgaatatccttaattcagattggcattggcctgtttccagggatttggattagcctgggattttctgtagtttcagattgtacaagttctgatagatttccttcttaccttttagggtttatgcgattcattgggcccaggctacccttaacctttccatttcagatcaggtcactgttgctatagaaaaccagacagaattcctgcttgggacaagagtaggaagaggcaagactgaatgagtggtcctctgcatggacaccactcactcctgaggctgctggcagcatgtaccctcatcctgcctcactccttagcagctagtgtgaacgtgaagaattgagaaatatagtgatcacatcagtgtgtattcattctggtcagcaaactaggcatatcttaagttttttaggaaatcactgttggcctccttttgtgtatcatagtgcaaaacagttttaattagttgaattattatagatacacaagaatttagaaaatgcgtctgggcgtggtagctcacacctgtagtcccggcactttgggagtccaaggcgaatggatctgcttaagtccaggagtttgagaccagcctgggcaacatggtgaaaccctgtgtctacaaaaactaccgtgtctacaaaaaaattagccaatcatggtgttgcatgtctatggttccaactactttgagaggctgtggttggaaagatcacttgagcccaggagttagaggttgcagtgagccgagatcacaccactgcactccagcatgggcaaaaaaaaatgagactcttgtttaaagaaaaaaaaaaagagtttagaaatggccattacgggccgggcgtggtggctcacgcctgtaatcccagcactttgggaggctgaggtgggtggatcatgaggtcaggagatcgagaccatcctggctaatacggtcaaaccccgcctctactaaaaatacaaaaaatcagctgggcgtggtggcaggtgcctgtagtcccaactactcgtgaggctgaggcgggagaatggtgtgaacccgggaggcagagcttgcagtgagccgagattgcgtcactgcactccagcctgggcgacagagcgagactccatctcaaaaaaaaaaaaaaaagaaaaaggaaaatggccattactttggttacactttaccaagcatagataaatatagagggctaggttgggaaaacccagtgtgtgaagatgacatagccttacattgaatgttattgggccagaatggtgcagaaagagagccagcaatgagaaatgggagagcacagagcagtgccccatctcagatacaatcagtgactttcccagcagcagagccttaagatacaggaaagaaaaactgacaaaattgaagggaaaaatcaacaattcagcaataatttggagactttgatacgccacttttaataatggatagaacagcttaagactataaaccaatgaggcctaacagacatctatagaacctcatcagaatacgcattcatctcaagtgcaagtgcagcattccaggatagaacatatgctagaccgtataacaagcttccataaacttcaaaggattgaaatcataaaaggtatgttctgtgaccccaatggaggaaaattagaaattaacaaggaaatttgggaatttcacaaatacatagaaatgaaataacacacttctaaataatcagtgggtcaaagaagaaatcaaaaaggaaatcagaaaacattttgaagtgaattaaaagaaagataaaacatactaaaacttacaggatgcagccaaagcggtggtttagagggaaatttatacttgtaaatgcctgcgtgaaaaaaagaagactgggcgtggtggctcacgcctgtaatcccagcagtttgggaggctgaggcaggaggatggcttgagctcaggagttcaagaccagcctggacaatatggcgagaccccacttttacaaaaaaatacaaaaattaaccaggtttgatgatgcatgcctgtggtcccagctactagggaggctgaggcaggatgattccttgagcccaggaattcgaggctgcggtgagctgtgatcatgccactgcactccaggctgggtggcaaagcaagaccctgtcttcaaaaaaaaaaaaagtgagttgtgtcgtatgtgaattgtatttcaataaagctattatgctgttaccaaaaatttaacaatgttgatagcttttcacatacctacatgcaactaatttgattgcaaaatcatatgtctacccttggcaggaacttacatttaagtatttgttctgtgaaagagtggatgaaaaggttaaactttactctgtgtttcattcttccccattttggttttgagagcctgaaagttacattgctgttgtcctccataaatgatgtgctgattccatggaaggactgtcagtggcatatacatcaaacttaatcagctctgatgaaacttcttacaaacttggccttcatttccttctttacattgcttttcttccacagttaaacccagttatttcagttatatatttcagtctgtatttttatccattcgttcataattgcttcaaacagaggtcagtagaaataggtctgtcattctctctccacttctttccccacttctactgcccagctctggaattgtgggcaagtttctttttgtctgggcctcagttgcctgcaaagtggggataataatcattcacctgccctaaagcaggaagctgaacttcatgagattccttttgatacttgagatctggagttctggcgcttcttgcagaaactatcttgtgttcctctttccttttcagtcgagtcctatctgtaatggccctgtgtattgtcttgttaaaatagtgaacatgctcccgtcccgtttctcagtgttccttggagagaagggggtgggggagagtcaagcatttgaaccaaattctcacgactacccagaccccattcttgggaacctgctattactacctgctaacgataatactctcagtaatggagatagtttactgcatttggttttctgtcttatgcaaaggttattaaattcttaattactaaaatgattgatttttcagttctttattaccagcttgaatgggcaatgccgctaaagattttaaggcagatttaagtagttttcaatttgagtaatttttcttgcttttgcttttcacaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactaggtaattttcagtctttatcctgaatggaacagatgattatgttgaattcaagaacatagatggctaattttacttttgctcaaaatttaaaatgacattaaaggaaagttctttgcagtggaagggttttctgtctgtgagccaagagaagcagagaaaagactccaggaatcttgtcagttctaactctgtgttcttattttacctcagaacatttctattaacgtataaagctggaggagcatcctcatgttctattttaaaagttgatgatgccaggcatggtggctcacgcctgtaatccccacactttgggaggccaaggtgggtggatcacctgaggtcaggagtttgagaccagcctgaccaacatggtgaaaccctgtctctactaaaagtacaaaaaaaattagccaggcaggtggcacatgcctgtaatcccagctacttgggaggctgaggcaggagaatcacttgaacccgggaggcggaggttgcagtgagccgagatcgtgccattgcactccagtctgggcaacaagagcgaaactccatctcaaaaaaaaaaaggtgatgacaattatcttagcgaaaagaaaaatctgacaagcatcctgtaacaccttgaaagtgtatgattatttccaacctaaagtagggtacatccctttttttcatgattttattatagacttttctcttacacgttgtctctgtatagatggggaattttgtcatcatgtttaatctttgggattcagctaattatttaagagcgaatagttttaaagacatgtttatattcagtatgcaggtaagaaagtggatgtgtaagtgttttgagtaccaaatgctgtatataaaaaacattattacattaatcttgaaatctgtcatcttttaacagctgaggtctctctttaattctcttaaataccatttctccctcaaaaaagaccattagatcatttcacaaatgtatctgccaccaaacaggtcagagctttgcaactttgctttgtctcttaacctctatggcaaagggttttttagcctggtggaaaagcataacagcagggatttagaagatagagctagttctggcccatcactttcatctccatcacacccggactggggttatatagttctgattttagtggcaaccctgggggaacttgatacccaggtaggtggtcactgatcagtagttgggagaggtaggaattggtgagtacaggtaattagaggaaagtcttgtgtcctgtttccccccttttaattttatcccttgctagaattaagatactatatgcctcacttatcaattacagtctaaatccaaaagaagtaattcaggtaaaaatatgcttttgtttttttcataaatttttttttcttttcttttttagatggagtctcactctgtcgcccagactggagtgcagtggcatgatctcagctcactgcaacctccaccttctgggttcaagtgattcttctgcctcagtttcccaagtagctgggattacaggcgtgcaccactgcacccagctaatttttgtatttttagtgtagatgaggtttcaccatgttgaccaggctggtcttgaaactcctgacctcaggtgatccacctgcctcagcctcccaaagtgctgggattatagacgtgagccaccatgtctgaccataaaattttctgtcatatatctttacctactaaaatgaagtgtgaaatattggaatggagttgggggattatttaaacagttccctgccaaatgactgccattggatgccctgattgattaagatccaggctgggcgcagtggctcatgcctgtaatctcagcactttgggaggccaagctgggtggatcaccagaggtcaggagttcgagaccagcctggccaacatgatgaaatcccatctctactaaaaatacaaaaattagctgggtgtggtggtgcacacctgtagtcctggctactcaggaggctgaggcaggagaatcacgtgaacccgggagacagaggttgcagtgaaccaagatcacatcactgcactccagcctgggtaacaaagtgagactgcctcaaaaaaaaaaaaaagatacaggactgggcatggtagctcatgcctgtaatcccagcactttgggaggccgaggtgggtggatcacctgagctcaggagttcgagaccagcctggccaacatgctgaaaccccgtctctactaaaaatacaaaaaattagctgggcctggccacatgcgcctgtagtcccagctactcggaaggctgaggcaggagaatccctcgaacctgggaggtggaagttgcagtgagctgggatcgcgccactgcactccagcctgggcaacagagcgtgactccggctaaaaacaaaaaactaatttgcattattttaagtccattttcttttcttttctttttttttgcccattgaacatgagaccagtgctcattctcctagaagatgctgataatatttgtcaccctgtagcacccccagtgtttttctttgttttttttttttttgagttaagaaatgtgaatgtgtgaatgaatcactctttgacacagtagtctagtggcattcagaatgtcaccacaaaggcccagaatcttgacctggggtcatcaagaaagttatattgattatgccttattaccaagatatggaagcatataaaacagcgttacatcagaattacaatgggccaggtgcggtggctcacgcctgtaatcccagcactttgggaggctgaggtgggcggatcacctgaggtcgggagttcaagaccagcctgaccaacatggaaaaccccgtctctactaaaaatacaaaatttagccaggcgtggtggcacatgcctgtactcccagctactcaggaggccgaggcaggagaatcgcttgaacctgggaggcagaggttgtggtgagccgagattgcgccactgcactccagcctgggcaacaagagcgaaactcagtctcaaaaaaaaaaaaaaaaaaattacaatgaaagttttagtggcttatgacagaacttcatgtactctaaaatccccgtgccgtattccagaaggctgcctgttactggcatcttcaatagtaaatactccagttttctgctgcagtggctcatgcctgtaatcccagcactttgggagggcaaggtgggaggatcactggagcccaggagctcgaggctgcaatgagctgtattcataccactgcactccagcctgggccacagagtgaaaccctatattaaaaaacaaaaggaagcactccagttttctgtaaaagtcctcctataccattgcttcttataattagtttacatgagagtcacctgggagtttgttgaaatgcaggctctgattcagtagctttggggtggggcctgagattgtgcctttctaacaagctcccagactacacttggaatagctaggtcctaaaacatctggcctctcagtttcattgtgacgtgctaagtggataaaaataccttactaggagtttcctagggctcacgtaaaactatgtagtcataaatgtaaacttcaggattaccacacaaatatttttggaactcaagacattaactgaggactcctaagttaaaatgcacccagtgcctaagatttttccccatagaattgaagcatctaaaattaaagctggttaaacttgcagaagaaatcattttttaagtattttttagtccaacatttaattatacagttcctaaaataacctgtggaagtacagacgattctgttgccctggttagagcagcctgggttcctagcaatgccagcacttcaggccggtgtgggagtgcaggggacggcctgcctacttcccaccagagtgttccgtttacgtgtgcttttacactcttgtgtacactgatatttgggaacagaaactttattaatgacctttacaataatcttggtgaaaggtatatgttttcaattaaccttagtgaatttacttgaaaataaaactatcccttctagctcttcatcttttgagcaagaatttaccagaatgtgactttagaaaataaggaaaactgataatgcttaattaaggtagtaaatagccaataaatacttcttaaattgttagtttatggacttctctctctttggggtgcaaaagaagtgaccagaagatgtactgctcttggattttaattttctaagctctctgcctgttccttgtatagtgcgctctttgttcatatgtttatgcacctgtaatttgtcactttttagtttctcttttttatactcttttcccttccttttacttctttcagtctaccaacaggaagaatgtttagaaacagtagatgtttagcccgggcgtgatggctcacgcctgtaattccagcactttgggaggccgaggcgggtggatcacgaggtcaggtgttcgacaccagcctgaccaacatggtgaaaccccgtctctactaaaaatacaaaaattagccaggcatggtggtgcgtgcccgtaatcccagctactcaagagtttgaggcaggcgaataacttgaacctgggaggcagaggttgcagtgagcctagatcacaccactgcactccagcctgggcaacagagtgagactctatctccaaaaaaaaaaaaaaaagaaaaaagaaagagtagatgtttaatgattggagaattttcaaaactggctatgttttgagtgcacaggttttaatcttaatatatccttacatttactaacaagcaagagttgtagcatgaatacttagaaatagtacgaacaaaatgctaatttcaatttattgggagaaatttgaacttaattgacttttgtcaattatgaaacctaaagttttctttttaacaagaaaaaaagagttgttgtttatacctctggtttttaaatggagtgggagcgggatattttaagaaagggatcgatgctttcagtaatgccccctttttgaggctgcatgaccctgagatgtcacagtatcctgaggcgcgaaggcgactcaggccagcagtgagctgagcaggagacagcatttaaacatcaggggagtcacttcagggcactgagtttctcttttcaacttttcttggttttctaatcagaatgtcagcctgtacagtccttactcatttttctactgttataaccatctaatttttatttcacttttatatgtatttgattattcatatccactattggatatgaatatgaatcactttaaatatcattttaaaattaagtgcttgactagaatccgtaaagaatgttttcaaagcttctaacttcatggtaaggtgtgttctatgggaagcagagaatttcagcagcatggcttctatcctgccgcgcccacctgtggtatcttaaagttcttgattatcacagagttttaaagatttttgcaacaacgaatattgtaagtctgtttagaaattacaagtacagattatacaaatagctttttatttttgttgtttgtttttgcatttatatagcgcctttccttcgaggagctcaaggcatttttcaaaatctgacagtttttctcacaacaaccctgtgaggtaggtagtgtgtgttaaaaacaatgagatactgactaacccattctagccttttaaaatgttcttttatgttaagtaatttgaagtgtcagcataaattagagttttagaacattttacaaaccttttaaagtagtttgataatagttgtattttttaaaaaaccacttgtacttcataacagggtgattttaagagaaacaaatcattcttcaaaagatcaggagtcactccatgtgattagctgagcactgattgcaggactcagccaggtatgtttttggttctcgtttattttcaggtcaagaaggactgaagagctgatctgcgactcctcactcagcgtctacaaactgtggatttgcagctaaactttcttcagagggggaaatgtgttcactatgttgcctcatggttttattttatatcttaaatatttgagcatttttctctcttcctctctccttccctgtctcccttttttctgttccccttcctgttccccacccctccagtcagctcttgattgtgcatgctaatgaagggcacagtagcacagctaatacagtctacaacttttcttcactgccacagtggggagacagaaaaaccaaatagcaagaaaacctgggaagtgagtctctggaaagagtggggaacaggtgtgtgggagtgtgaattcatatgtttttttcctgcccctttaataataatcaattgtaaatgacatttttatttttcttataccagccattgattggaagtgtaaaaagagaaaaaatagatatgtttggttgatttaaagtagcaaattttctattaagggagggaggacggggcatattggtttggaaatgccaaataactgtttttcttgcctcccttgtcacccacccccccacccaaatacgaaattttaaaattcacatttgcgtccatcccttccactgtattgtcagtatacaagctagagctgtctctggctgggcccagtgctgatgttcaatggcaaacgcaagtcaaatcctcttctaaccatgaaacaatgtgaggaaggctctcctgagccaggtgatataacaggaaccagaaaggccagggtaaatcccaggtcttccattcattaaccctaagtcattggcaatctactcagccttgttgggccttattttcctcatttgtggaacaaaagggctgttctaaattatctggcctttaagtgtcagagtaaaaggatagttttatgcagtttgtatgggagatttagagtgattatagttaaggagagagggtatttttctgttcaataataggaaaaaaaaaaatttccctaaggttttcagtgcatttgcaccagccctaataggtataacagtcttaacttttattttccacagtatttgttacaatgggatttgatttggactatcagccagctgacttttacatacttctgtaggattattgaaaacaactgtctcatctcctgcctgtctgcacccttaaccattttcttcccccttttccttactgtcatttcatgcccatagcagccaactgtgacagtaagttttaacaggtttgggacagcaacttatatttttagtgaaatagaggttcttgctattggtagcaagggatagtttcaggggttttatttatgtttgaggcaataaagtcaggaaagcagaaacagaagtcaacacagggaaggtaggcagaatactactaaatcaagagttgactattttgtgttggttttagcatgtaaattgtttggcattatgaataaaaagtaaacaaaaccaaggttacctgaaggcatttttagataggaatgaacttgtttcagaaagcatagaacacacataaagcctattaaaaatagccaagtttcattccaggtctataacttacttttgtataatgttcccattggtcactttcacattgaacgtgtaaagatagcttggccctttctgtcgtttgtagccctgtcatttaacggcatggataatttattgcatttgcttaaagtgaactattgcttttctgattgccacacaaagcacgggttatctgtttcccaccatttcatatttcatatttcatattgctcgacaggtcatgccttagctgagagctgctttgttgtcttatctgtccttcatgtgcaaataaccatgtagtgtaggattgcagcaagaatggtttccattggatttcttggagatggtatcttgacacaatcaattgtgatggctacaagtagttgagtatggatatttggatgctttcccaattctacagctctttattttcatggtggttctctgacaccatatgtcgacagactagtaagacgttctgaattgtttaaaggacttgcatttatctgtctgtaaaggcttgtataccaattgattgaaaatggaaaatagggccctgttcatttcttcagtattatctctaggatatgtttgaactttcagatggttcagctaatagttgtgagaattcaggattactgaattaaaaaaaaaatgactagagtgtgtagctagtaagttcctggtagtatcagtatgcattaatacacctgaagtcttccagtgatcctgtccagtaaacagtattatacctgttcaggacctcatgtctttcctcttcctgattctggtactttactttattattgctacctagctgaccctggtcaactctttgaatccagcttgattaagatcttctgcttagacttcccctcattcttccttccttttgattcttacctgcttataatgtgcttttcttaaacctttcccatgtacattttgcaccctagttataatttctatacttttaggtgctatagcaatgcagtttttagcatattaacatgcatttgcatattgatcacttgcttaactgtttgatgcatatatatgtcttttagtcccaattaaattttccattcaagaacagtggccatgtcttctcttgtatttttcaccatagcacttcatatgccactgtatacacaacacagcacctaataatccttgatgaaatactgtggcttgaaatcttactgaaatactatgaatacatatatgatagcttctctaggaaaaaaaattctgctgaatgcttcctttgctggagtttgtgctagatcttacctcaattttagcatattcaggtttatgaaatgtacaattttaaatgtcagagtaagacacataaagatttttttctcctgaaccactaatattttttcttaatgtattttatttgaatggcaatcggtgattccttttttctgttggacgttttgttttgtttttttgatacagagtcttgctctgtcaccaggctgaagtgcagtgacgcgatcttggctcactccaacttcaactctcgagttcaagcaattcccctgcctcagcctcctgagtacctaggactacaggcgtgtaccactacgtgggcctggctaattttttgcattttagagacggggtttcaccaggttggccaggatggtctcgatctcctgacctcgtgatccatccgcctcgacctcccaaagtgctgggattataggtgagagccaccataccgggccataatccggttagaattagctttatgaaaataaaataaaacttttttttaaaataaaaactttatttgggagaattagctttatgaaattgacatgaaaagaaaatttgaaattaagatgctagtaactttatagtacacgttttactgaaaacacagctttagaatgaggggttcacaaatttgtcttgcttgggccatgactgcatcatgcataaatacagacctaatgggataatattctgaagacatcagtgtggctgattctacaatggaagccttttcaattctacccctgcaggccaggcgcagtggctcacacctataatcccagcactttgggaggccaaggtgggcagaccacttgaggttaggagttcaagaccagcctggccaacatggtctctactaaaaatacaaaaattagctgggcatggtggcgcacgcctgtcatcccagctacatgggaggctgaggcaagagaatcacttgaacccgggaggcagaggttgcagtgagccaagatcacaccactgcactccagcctgggccacagagtgagactccatctcaaaaaaaaaaaaaaaaaacaactctaccccatcagttttcctacattaccagtatagcaatttcaccactagagttaacactgcttgtactcgttttgttctctgaatgcagtcatcaaagatgactttgacatgggtggttagaacatcaaggtgtgtttcgaagcctgttggaatacttagtttggggttttttctgactgtgtacataaagaatgtttttgtgtatggcatggttttgtttacatcatcatacttctgaaattcattgcctggcactcttccagcttgattttgcatgttttaaaaagattcttgtcattctaactctaaattaggtgtgctgtattctagagctttgattttgtgtctcccaaagttgacgactagtgtaagtctgaatcagacagcttttgtttgaatcgtctgctcacctcacagttaatgagataacagtgaaataaaaataattaaaataacagattgaaaaaagagaagttactgagataacagtgaaataaaaatattaaaataacagattgaaaaaagagaacttgcgtatccaggtgatcagtattacttgaatagtagtaatcaagactattgattgttgttctcttctcttagatctttgctctgataaccatggctgtttttagggtattagctctttctcaagatctgttaagatggatcagtggcgcaaggattgtggcagataacccattcattcttttgatttctttcagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtaagtttattaagactgatgctgttaacctatttggataagaatagtgaagtaaattaaaaccctaaatgttagttaatactgaaattttaaatttatttttcataaaactaatcagtctgaagatcttgtaacacatacagtcatttggatgacagtccagagaaaaaactgggccaggctcagtggctcatgcttgtaatcccagcactttgtgggggctaagatgggagtattgcttgaggccaggacttcgagaccagcctgggcaacatagcaagactccatctctaaaaaaataagaataaaaaaattagctaggcatagtagtgtgtacctttgtagtttgtagttccggctactcaggaagcagagccagaagcattgcttgtgcccaagagttagaggctgctctgagctatgatcatgccactgcgctccagccctgggagacagagcaagaccctgtctctaaaaccaaaaaaggagagaaaactttgtcatatagaggtgaaattcattatgagccttaagggaaacaagccattaggtactcatacagagtgagtacccttaaccccaaaatttgaaatgctccaaaatctgaaactttttgaacaccgacctgacactcaaaggaaatgctcatgggaggattttgaattttttgtttagaggtgttcagctagttactgtaatgcaaatattgcaaaatgagaaaaattgtgacattcaaaactcttgagtaacaataaagtttgttacctaatgatcttactttttttgtttattttattgtttttttagaggcagaatcttgctctgtcacccaggctggagtgcagtggcctgattatggctcactgcagcttccatctcttgggctcaagtgattcttcctctcagcctcccacgtagctggcactaaaggtacatgccatcatgcttggctaatgtttttcgtagagacagggtctcgctatgttgctcaggctagatcttacatttttttcatcattgcgggtggtttgcttttataattgtaagaaagtctagcagggtataccatttaaagtcattatcaatttttttttcctgttttaggtatttatttatttgcgaatgtttgcaactgacagtggatttgaaatattgccatgtaatagatactcatcagaacaaaatggagccaaaatagttgcaacaaaagagtggtaac

SEQ ID NO: 13398 - DNA, 193 bp, Homo sapiens; identical to SEQ ID NO: 7690

SEQ ID NO: 13399 - DNA, 33 bp, Homo sapiens
gagactccgtctcaaaaaaaaaaaaaaaaaaat

SEQ ID NO: 13400 - DNA, 93 bp, Homo sapiens; identical to SEQ ID NO: 7709

SEQ ID NO: 13401 - DNA, 136 bp, Homo sapiens; identical to SEQ ID NO: 6219

SEQ ID NO: 13402 - DNA, 192 bp, Homo sapiens; identical to SEQ ID NO: 7720

SEQ ID NO: 13403 - DNA, 300 bp, Homo sapiens; identical to SEQ ID NO: 6744

SEQ ID NO: 13404 - DNA, 142 bp, Homo sapiens; identical to SEQ ID NO: 7400

SEQ ID NO: 13405 - DNA, 123 bp, Homo sapiens; identical to SEQ ID NO: 6220

SEQ ID NO: 13406 - DNA, 268 bp, Homo sapiens; identical to SEQ ID NO: 7767

SEQ ID NO: 13407 - DNA, 4802 bp, Homo sapiens; identical to SEQ ID NO: 7769

SEQ ID NO: 13408 - DNA, 205 bp, Homo sapiens
accaacatggtgaaaccctgtctctactaaaagtacaaaaaaaattagccaggcaggtggcacatgcctgtaatcccagctacttgggaggctgaggcaggagaatcacttgaacccgggaggcggaggttgcagtgagccgagatcgtgccattgcactccagtctgggcaacaagagcgaaactccatctccaaaaaaaaaaa

SEQ ID NO: 13409 - DNA, 368 bp, Homo sapiens; identical to SEQ ID NO: 6222

SEQ ID NO: 13410 - DNA, 2925 bp, Homo sapiens; identical to SEQ ID NO: 6223

SEQ ID NO: 13411 - DNA, 128 bp, Homo sapiens
tggtggggggcattggctcacgcctataatcccagcactttgggaggccgaggcaggcagatcacttgaggtcaggagttcaagaccagcctggccaacatggtgaaaccccatctctactaaaaata

SEQ ID NO: 13412 - DNA, 4704 bp, Homo sapiens; identical to SEQ ID NO: 7404

SEQ ID NO: 13413 - DNA, 9877 bp, Homo sapiens
  misc_feature (7341)..(7341): n equals a,t,g, or c
  misc_feature (7354)..(7354): n equals a,t,g, or c
ggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcagtgagtcatcgggccaccgcgagacgttccgggcggtcacggggctcgggagttcggggccgggtggggagagctctcccaggcgcgatggaggcaacccgaacctgaagcagccacactgccttacatttgatccttctctcagttttttccccacttaatcaccgctgaaaaatttccaccccattgaagcagctaaggctccgacaaggtcacagagcctagtgaatggcaagcccatgcggggtgggtttgggtatgaggaggaggtcattgctggctggactggccaagaggggtttcacaaagaagagtagcatctaaactggattgacaggaatggattggaagtgagacatttcagtgggaaaagggaattgtgccgtctgtgtcattttgtcctttttgtgctgttttttgtgtcctaaccagctgcttttctacagctactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtaactcagctctggtcttaccttattgaggggattttaaactgaagtcagctccaggacagtaggtgtaagaatgattttcggctgggcacggtggctcacgcctgtaatctcagcgctttgggaggccgaggcgggcggatcacctgaggtcaagagtttgagaccagagtggccaacatggtgaaacgctgtctctactaaaaataaaaaaaaaaaattagttgggcgtggtgacacgcacctgtagtctcagctactggggaggctgaggcaggagaatcgcttgaacccaggaggcggaggttgcagtgagccaagatcgcgtcactgcactccagtctgggcaacagagggcgattccatctcaaagaaaaaaaaaaaagagttatttcattccctctaggctgttcaggactgaagtgggagctgaagttgtgatctaattggcattttgaatctggaggccccttttgtggactcctttgtaagactttgggtgactggtattttatgctaaaaataggaatagtatgttttgaatggccatctgtcagtttacgttttttaaagtaaggggaatattgttagggaagtagacatccactgtctccttgccggggagaagtagtacagagtttggcaagtgaggagcatggtttgcatccatgcactgggtcagatctcagacctcagttctgtgagacagagttcctagggaagcattggcttatactgtgttataataagtgaaaaatctgttacttttaggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctctttttttttttttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgccgtaaagcgcggatgcgcggcgtggccacgccccttcagtgcttgtgacgcaggcgccctgggctttttgggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccaggtatgcagggtcccgccccgaagccgaccggctgcgcgggcctccccctagccttttggctaccgggccccgccccgggggagcgcgctgagctccgcttggcgccttctgatctttatttctcgcgccgccgtttcggtgggaggagcaggggtgatttacggatactctttgccctcagatcctgggaaaagtctattccgttctcagtgacagagaacagagagcagtgtacgatgagcagggaacagtggacgaggactctcctgtgctcacccaagaccgagactgggaggcgtattggcggctactctttaaaaaggtaaaggactctggaggtttctttgtgactgttaccatcattcaatcaacaaacctttattgactgcctctaagatcttgtattttgtgttaattttgtaggaattaggaattttgagtttggccttgaaatacagatacacgcacgcttactgaaacgggctttaaatttcctgttaatgtgattgttgcactgaaaagggccgatttattttttttgccggatgcgctttattttacatatccaaatgtaagtcctgattccggatcacctctcactcttggaaatttcacttaaatttcccttccctggtccctagttagcagttaatgaagattggatttaaaaaggaggactccggagaagcttaggcatagaaaatctggttcaataatttcaactcaagcaactgttgtattgcagcaattcaacacccaactctagttttactaacgtacgttttatttaaagtaaaattcccaaagttaaagcaaatctcctttatcatcagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggtaagattttgaatactgtggatttatattttgactgcttccaaaaaggatttgagagtatttacagcagtagaagtaaacataaaactccagaaataaggactagggttaacttggtctatagtttcgatctaataaatgggcataccagttcatcaagagaaactttttctagcatgttgtgctcaagatgatttttattgcatagattgtttaaatattaccatagtaaagtagcactgaaatattttttcatgtaggccaattcttgtagcattcctgaggcattcctcagggagaataaagttagtggggaacccgggtacacaggatgggcagtgatccttactcggttgagggggtaagaagagaatggcagacaccgtcttgttaaaagtgcagatgtttgggcctttgccccgaatttgattcttgagttggatacagaatttttcttttcttttttttttttttaaagaaaaactttagcttagcggtccccagcctttttgataccaggtacctgttttgtggaagacagtttttccagtgacagtgggggtgaggagagttgggggggtggttcangatgaaaccttanatcatcgggcgttagattctcttaaggagcacacaacttttaggaccactgctgccttcctgagtgccctcaggaacttttctgcagcttttacataagagacgctggcagagagaaagctgacctttttgtttccggtgaaaatttgaagggcctggtttgcctagataagaggctgcaccctttctggagagcttgaggggaacggggggagcgatatcaagaccattttggttcataggctacatctgctaagactcaagctgacaattatcttaagtcgttcatcatttcctgagatgaaactgagcacagctgcattcacagtagactgttagcttgagaaacttccctagaatttgaggagaaaatggcatagttttgatagactgttcaacaaaccttagggggatgctgaatttaaagagagaatttgaatacaaggaaacggtgtcttattgggatagggggtcctaatgtatcatcatcctcagtattaatagcattaattgctacttagaaaattcacaaggggtgttggggcctcttatagttgttgccctaaggtgttcttgtgatattttgtaaacaatgctctaggaacacttggcaaaggaaggctgctttgaaattaggtaaatagatgttaaaactgagtttattgatgttggttcttctgactactggggagaagtcattttaaactggggttgttcacaaggcaccaccagtcccatggagtaaattgggtttccaggagagaaattggaaatacctgtatcctggcaattgcatcatttgccttttttttttttttttctcttttttctaagagatggcatctccatcacccaggctggagtgcagaggcatgatcacagcttattgcagcctgaactctcagactgaagccatcttcccacctcagcctccctagtagctgggactacaagcacatgccaccacaccaggctcatttcttttcttttttatagaactgaggtctcactatgttacccaggcaggtcttgaactcctgagttcaagtgatcctcccaccttggcctcccaaggtatggggattacagttgtgagccaccatacccggcctcatgttcctttttatcatcatgtgatttatgagtgccagagtacttactacctctagcaaatagaattgggtaaaaaacaaatggtaattggaatcagaggatctactgcttgctgtcagcattgttgccatttaatgaatgacatagttatgtaattcgattcattttgtctattcatatattcataaaattgaaacagaattatagatttgcttttgggaaagagtatgtattttaagcatttcctggtggccctgagtctcatgtgagttcctgtttcaggctcaggaagaggccaaagaagcagaaatgagcagaaaggagttggggcttgatgaaggcgtggatagcctgaaggcagccattcaggtaaacttggcagtttgttgccacatctttaatgatctgattcctactgctaatattttctttggaatgttgtattttgttttcttcttttaagacataaccgcataccttctatttgtccttttaaagtgtacaatttggtggttttaagtgtatttacaaagttttacaattattaacaccaattgtaggacattttcaccattccaaaaaaactccatacccattagtagttattccacttttccagcccctggcaaccactaggtactttctgtctatggataatgttgtgaaagcttgtgttttaacttctcaaacagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccaaacacttgctggacagctatcttccacatactttccagtttaacattggtcttaatgatcttgaatagaatcctctcttcattttactccacccagtttgtgaactgatggtacagggttaaattaccttgaaacatttttgtgaagaaggtgtttataattcaattaaaaaagggagaaacatgattgattaaggttttggggccttt

SEQ ID NO: 13414 - DNA, 5156 bp, Homo sapiens
ggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcagtgagtcatcgggccaccgcgagacgttccgggcggtcacggggctcgggagttcggggccgggtggggagagctctcccaggcgcgatggaggcaacccgaacctgaagcagccacactgccttacatttgatccttctctcagttttttccccacttaatcaccgctgaaaaatttccaccccattgaagcagctaaggctccgacaaggtcacagagcctagtgaatggcaagcccatgcggggtgggtttgggtatgaggaggaggtcattgctggctggactggccaagaggggtttcacaaagaagagtagcatctaaactggattgacaggaatggattggaagtgagacatttcagtgggaaaagggaattgtgccgtctgtgtcattttgtcctttttgtgctgttttttgtgtcctaaccagctgcttttctacagctactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtaactcagctctggtcttaccttattgaggggattttaaactgaagtcagctccaggacagtaggtgtaagaatgattttcggctgggcacggtggctcacgcctgtaatctcagcgctttgggaggccgaggcgggcggatcacctgaggtcaagagtttgagaccagagtggccaacatggtgaaacgctgtctctactaaaaataaaaaaaaaaaattagttgggcgtggtgacacgcacctgtagtctcagctactggggaggctgaggcaggagaatcgcttgaacccaggaggcggaggttgcagtgagccaagatcgcgtcactgcactccagtctgggcaacagagggcgattccatctcaaagaaaaaaaaaaaagagttatttcattccctctaggctgttcaggactgaagtgggagctgaagttgtgatctaattggcattttgaatctggaggccccttttgtggactcctttgtaagactttgggtgactggtattttatgctaaaaataggaatagtatgttttgaatggccatctgtcagtttacgttttttaaagtaaggggaatattgttagggaagtagacatccactgtctccttgccggggagaagtagtacagagtttggcaagtgaggagcatggtttgcatccatgcactgggtcagatctcagacctcagttctgtgagacagagttcctagggaagcattggcttatactgtgttataataagtgaaaaatctgttacttttaggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctctttttttttttttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttc

SEQ ID NO: 13415 - DNA, 1581 bp, Homo sapiens
tttttaaaaataaaaaaagtaaattttaatgaagttatcttacaaaaaaatgtacaaatcatgaccgtgcatagtgcttgatgaattttcacaaagtaaacatatccatgtaaccaggacaaggttctaaggtcttctactggagttttcatgaagtagggaaataggaagagccaattccatcccagggaactatgttctttagccgtagccccacaaaagaggggtcttcaaagccacataaagtatatcacgtatgacatatatctttccctttcttcctctttcatgtagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattcatcagcatggttctggagttaacgtatactgagttacatgtaggtatttagttatataaataactatagtgtaattgctataataattatatggcatatatatacatacaataaaattaaggtatagtggggtcattattagggtttctgatgaaagcttattggatcactcctggaggaagtcaggtgctaaggtttctggacaggttcagttaactgaaatacaggaattaaggcatcattttcaaaggtggccctggaggaagactgctatgctgggtcactgtattagggcaaagagcatgctagccctttggaactaacagtaaacgaaaaagctgaacagagaggtctttgctgaaggtggagctattgacaccttctcaccaaacacaggcatcttcatggatctaaaccactagggctccaaggagacaccgttaccctcatcaccgaggtcatattctagggctacagataaaaaaaaaaaaaatcatacttcacctctgccctggatcacagcacggcaaaagcaggaataacccctccttttttttttaaggtgtgactgcctcgataggggtgggacgacaacaggagaaaaggtgagaggtaaattaattttggttaacgagaaggataaagtaaaatctagtcacttacaatccttctcctagtctcggccctgacactacctcctctgtgaagtcttccttagcaagcactaggtttgccttctctgctcgctgtccttgcgctgagtactactgatcgcgctagtttctctgctgtcatctcacggtctccccagcggactgtgagctccacgaggaaagaacagcgccctttagtatttgcgttctcagcgttgcgcctcggcaccaacgcttgcaagatggatggcttttgtagcactttccttggcgcgcctgggattcgcctaaaacttctgactccagcagggactcacaagtctgagagggatcgcac

SEQ ID NO: 13416 - DNA, 302 bp, Homo sapiens
aatgtggggccgggcgcagtggctcacgcctgtaatcccagcactttgggaggctgaggcaggtggatcatgaggtcaggagattgagaccatcctggctaacacggtgaaaccccatctctactaaaaatacaaaaaattagccgggcgtggtggtgggcgcctgtagtcccagctactcgggaggctgaggcaggagaatggcatgaacctggggggcggagcttgcagtgagcggagattgtgccactgcactccagcctgggcgacagagcgagactccatctcaacaacaacaacaa

SEQ ID NO: 13417 - DNA, 1580 bp, Homo sapiens
tttttaaaaataaaaaaagtaaattttaatgaagttatcttacaaaaaaatgtacaaatcatgaccgtgcatagtgcttgatgaattttcacaaagtaaacatatccatgtaaccaggacaaggttctaaggtcttctactggagttttcatgaagtagggaaataggaagagccaattccatcccagggaactatgttctttagccgtagccccacaaaagaggggtcttcaaagccacataaagtatatcacgtatgacatatatctttccctttcttcctctttcatgtagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattcatcagcatggttctggagttaacgtatactgagttacatgtaggtatttagttatataaataactatagtgtaattgctataataattatatggcatatatatacatacaataaaattaaggtatagggggtcattattagggtttctgatgaaagcttattggatcactcctggaggaagtcaggtgctaaggtttctggacaggttcagttaactgaaatacaggaattaaggcatcattttcaaaggtggccctggaggaagactgctatgctgggtcactgtattagggcaaagagcatgctagccctttggaactaacagtaaacgaaaaagctgaacagagaggtctttgctgaaggtggagctattgacaccttctcaccaaacacaggcatcttcatggatctaaaccactagggctccaaggagacaccgttaccctcatcaccgaggtcatattctagggctacagataaaaaaaaaaaaaatcatacttcacctctgccctggatcacagcacggcaaaagcaggaataacccctccttttttttttaaggtgtgactgcctcgataggggtgggacgacaacaggagaaaaggtgagaggtaaattaattttggttaacgagaaggataaagtaaaatctagtcacttacaatccttctcctagtctcggccctgacactacctcctctgtgaagtcttccttagcaagcactaggtttgccttctctgctcgctgtccttgcgctgagtactactgatcgcgctagtttctctgctgtcatctcacggtctccccagcggactgtgagctccacgaggaaagaacagcgccctttagtatttgcgttctcagcgttgcgcctcggcaccaacgcttgcaagatggatggcttttgtagcactttccttggcgcgcctgggattcgcctaaaacttctgactccagcagggactcacaagtctgagagggatcgcac

SEQ ID NO: 13418 - DNA, 6708 bp, Homo sapiens; identical to SEQ ID NO: 8511

SEQ ID NO: 13419 - DNA, 237 bp, Homo sapiens
tttctatttttaaaaatttgtcagtatgtgccttatggcccagaatgtggtatatcttcatgaaagttccatgtgaactcaagaacaatgtgtaatctgcagttacgagtgtagtagtctataatgctcattatatacacttgaagaatggtgttgctgagtccagctatgtctttacttattttctgcctgccagctctgtccatttcaaaaaacaaaaaaacaaacaaaaaaaaa

SEQ ID NO: 13420 - DNA, 1314 bp, Homo sapiens
cagagaaagcagtactgactctggagttgagcagatgtgggttcaaacccacatgtacatgtgaccagcagtgtcatcaaagagagttctgcatttctctgagcttcagttttcctcctatgcaaagaggggatcacatctactaccaagatgcaaaacagttagtacaaaatgactgctcgcagggccacatttatactgtggatgcattttggtcatattttggtaacataatctgatgtggctgactgtgtcatggcttcatacctttcatgctttggacttttgctgctttctgcaggaacgattccacgtgaagatcctccccatacatacattcacaagctcaaaggctatctggatccagctgtaaccaggaaggtaagatggatttgtttccactctttgttattgcttccttattagcgagcagaatcctcctgcattggaagagaccttccttcctctgcattagagcctctgccagagcctccacaaaaaacaaccttgggagaccaacaacgtaagaagacaaaggaaaaaaaacaaccttctcacttgaagatgtgtataaaagttctttcctgacatgagagtcacgtacctctgatgttgtttgagtcactgctatttccaattacgtagggcagtgagtgcattccagaggtattcaggcccctagaagagcaggctttgcaaagggaatacttgcctttcagttttttatgccttggtgcatttccagagaccttgaaaaatcactgggcctttgtcatcccagctgtgcactcacatcctgtgttgatgcttttagcagctcccccctactccccccaacccctgcccctggcctgagaaggtaagtagagaatagctgattccattctcaacagactctccccttttacaaacaagccctgctttgtgcagccacacaattggtttaaactgatgcctcgtggtaaagcatgtagcctggcacggccctgtgggcctgaatcagtcctgggatgtctcagggcagagctgtccttgctcaagatgggtgaaggggtgctttaccagatagcatttgtttttccattgacctacaactcctgcttttaaggctcctgcgaaaatctctcaggctgattctctctgttgtttcagtgtgtgattcttgagaaaagaatggtatactttacctagttagccattttcagggctcttgatgcttgcattaaaaaaaaaatctttttctttatcttctactctaactcttcctcccctcaccgcccaccccccgaccaaaaaaaaaaaaaaaaaaaagtc

SEQ ID NO: 13421 - DNA, 1314 bp, Homo sapiens
cagagaaagcagtactgactctggagttgagcagatgtgggttcaaacccacatgtacatgtgaccagcagtgtcatcaaagagagttctgcatttctctgagcttcagttttcctcctatgcaaagaggggatcacatctactaccaagatgcaaaacagttagtacaaaatgactgctcgcagggccacatttatactgtggatgcattttggtcatattttggtaacataatctgatgtggctgactgtgtcatggcttcatacctttcatgctttggacttttgtgctttctgcaggaacgattccaggtgaagaatcctccccatacatacattcaaaagctcaaaggctatctggatccagctgtaaccaggaaggtaagatggatttgtttccactctttgttattgcttccttattagcgagcagaatcctcctgcattggaagagaccttccttcctctgcattagagcctctgccagagcctccacaaaaaacaaccttgggagaccaacaacgtaagaagacaaaggaaaaaaaacaaccttctcacttgaagatgtgtataaaagttctttcctgacatgagagtcacgtacctctgatggttgttgagtcactgctatttccaattacatagggcagtgagtgcattccagaggtattcaggcccctagaagagcaggctttgcaaagggaatacttgcctttcagttttttatgccttggtgcatttccagagaccttgaaaaatcactgggcctttgtcatcccagctgtgcactcacatcctgtgttgatgcttttagcagctcccccctactccccccaacccctgcccctggcctgagaaggtaagtagagaatagctgattccattctcaacagactctccccttttacaaacaagccctgctttgtgcagccacacaattggtttaaactgatgcctcgtggtaaagcatgtagcctggcacggccctgtgggcctgaatcagtcctgggatgtctcagggcagagctgtccttgctcaagatgggtgaaggggtgctttaccagatagcatttgtttttccattgacctacaactcctgcttttaaggctcctgcgaaaatctctcaggctgattctctctgttgtttcagtgtgtgattcttgagaaaagaatggtatactttacctagttagccattttcagggctcttgatgcttgcattaaaaaaaaaatcttttcctttatcttctactctaactcttcctcccctcaccgcccaccccccgaccaaaaaaaaaaaaaaaaaaaagtc

SEQ ID NO: 13422 - DNA, 246 bp, Homo sapiens
ctcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacacgtatacatatgtaactaacctgcacaatgtgcacatgtaccctaaaacttaaagtataattaaaaattaataataataataag

SEQ ID NO: 13423 - DNA, 246 bp, Homo sapiens; identical to SEQ ID NO: 13422

SEQ ID NO: 13424 - DNA, 2393 bp, Homo sapiens; identical to SEQ ID NO: 12191

SEQ ID NO: 13425 - DNA, 2452 bp, Homo sapiens; identical to SEQ ID NO: 12192

SEQ ID NO: 13426 - DNA, 298 bp, Homo sapiens; identical to SEQ ID NO: 12193

SEQ ID NO: 13427 - DNA, 298 bp, Homo sapiens; identical to SEQ ID NO: 12193

SEQ ID NO: 13428 - DNA, 1071 bp, Homo sapiens
gtttcatcagtatgattatactcctaggtgaaaaaaaagatggagacaagggaaaaaatgaagttaacgaataaaacaaatgttatttcagatcacggccctgtgtgtgttactaaggaaagatataaggatttataacatatatttgttttccatttatttttatgaaggaattaaagaaattatcagaaaatactaaaagggaacaaagcattttaaaaacattccaacaatggcatgctgctttttatacagtatgcagtgaagttccttgcatttcaaaggcaagggtagctaaatctgcctcagccccttagcgttctgtactacccttatcttgccatttacaacatgaaagtataataatctatttacatgctggtatataccactatgagtttctgacaaacatggcacatcttggtggtagttcatttattctacaaatacttattcaatgtctactatgtgccaggcacacttttggacattttggatacatcaggtaagaatataaatacctctgccccatgaaccttacattctacctatattgcaaagttcctagcacatcgtagatttcttctcatggtcataagatgtctgcaccaattctaagcatcacatcttcatagaaaagcatccaaaacaggaaggaaaaattagaagcaaaagggctttctccttttgggcctttcttttcataggaaagaaaatctttcccagaaccctcaaacatgtgatctggaccaaacactggctggcaaagagtggaatttcttaagtctgagcaacaagaagaaaaccgttaccataactaccaactcacctgcatctgtgccatgtgcttgcctgcccacctataactaaggatgagctgtttgtagtcttaggtcaactcctccacttgtgccttggatcctgccgcacgcccccatcacctacttgcggacattactccaacagttcttttctttctgtcctgtattatcaaatttctgttcttactggattttcatgctctttcatcattatgaaagcatgcagtaatttcttcattaaaaaaaaaaa

SEQ ID NO: 13429 - DNA, 2256 bp, Homo sapiens
acataaccaagtacaaaggatttaatcagaaaattatccaatggtgatgtatttgaattcaattatggttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtcccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccaactagaagaaatttcttttctctgaacctccatagaattttatctgtgccatttctaagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccc

SEQ ID NO: 13430 - DNA, 2254 bp, Homo sapiens
acataaccaagtacaaaggatttaatcagaaaattatccaatggtgatgtatttgaattcaattatgttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccaactagaagaaatttcttttctctgaacctccatagaattttatctgtgccatttctaagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccc

SEQ ID NO: 13431 - DNA, 2257 bp, Homo sapiens
acataaccaagtacaaaggatttaatcagaaaattatccaatggtgatgtatttgaattcaattatggttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtcccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccacactagaagaaatttcttttctctgatcctccataggattttatctgtgccatttctgagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccc

SEQ ID NO: 13432 - DNA, 2620 bp, Homo sapiens
gcctaaatgtattgattacttgtccccttcctcctttgtgacaactcagatgtattatatccacatactacttactcctctgaattcctccagggtagttatgcttttgcaagatgtggtaagtctatattgacaaagaaactcccagttatctatcaatttgttcctgaatgaatactgatgaggacattgttgatgatatcctaacgtatcttttgtatggggaagacctttgtctcagttgggaaagcaatgaggcttctcctaatttggcaagcctttttatgccctaaactcaccaagtcttcccaatctttcctctttctagcttatcctatttctctttaactttctttatacgtatttttatttgtttttagtatgttgtgttttatgtagctttatgaactgtactttttcttctcctcctctttttttcttcatcttttaatagaggaatgtcaattaaaaaaaatctttttcaggggaagatagaaagagtaggatatattagtgtgtttgtttcctagagctgctataacgaagtactacaaaccgaatggcttagaacaacagaacttgattgtattccagttctaaaggctggaagtccaaaatcaaggtgttggtaaaaccatgctccctaaatatattggggaggatctgttccaggtctctcactttctgtcttcttcttctctttgcctctcatagcttcaggtgttccttgacttgtagatgtctgtcttcttccttcctttgtgtctcttcacatcatctttcctctccatctccctgttcagattttccttgtataaagacctcagtcatgttgaattagagcccaccctaatgacataattctatgattacctctgttaaaaccctatttgcaaataacgtcatattctgagacactgagggtttaggaattcaaaatatattttttgaggggcagacatttcaacccacaacaagcagacacaatgaaaaaattaaagcaaactggattttaaaagatagagatgagatcttctaggcccttcaaagagaacttcagtgagacaactagttgaagacagtgtttaggctgtttttctatcatgcaaagaattccttctttgtatttatattttgctgctccatttctctttgacttttcctttcctttctttttcttctctcttctattttttaagagggaatataccctcttggtaaaaaattcaaaaggtctacaaatttaaatttacatattttacaaagtaatgcaatatttattcattttataaatataaaaaaattaatatgtaatcattttagaaaagttttaaaaagcaccgttaaaaaagcacaacaaaaacaataaacttatgcaaaatttcaaacctaacagatcatctctgacaattttaggatttatatttttgttttatatatacaatatagttggatattttatacaattgatattatttcatatacccattttctagtccttttagcactaacaagcatactatgaatattttctcctgtcactaaatatccttcacagcatgagtttttgcagtgttctatgaaataaaataccataaaattttcaaagtcttttgtggtatatttagattgccttcaattttacagtaccatacaaataattctgtgatgaacatatttgtaagtaaatctttatttaactccttgactactttttaattttcttctagaaatgaaactgctatattaaagtgtaaatacattaaaatactctggataaatgtcaaataaattatagccaaacatccatcatggccactaaaaaagtctcaataaactatttattaaatgtctagttttatcacatgtgactttcctagtttgccatctgagacaacctaattaaaaattactcccttacgtattatagctacataagataattagctacaaaatacctatgtctacaaaaatgcttgttttacttcagaaaagtttagacaatatttttttcccacatagtaatctagtgcatgaaaataaaatgtccaaaaaatttatatcagagtttaaatgagtatggtggtttctaaaacagatgcaaatccttttaactttcctcccattgaaaagtgcagtctatctttcctttccttctccctggtagacttgtgaccaattccaccaataaaggatggtggaactgacactgcaacttctaaggtgacactatgcaaaggccacttggtttgcagcttccaccttgctttagtggaatacttggttgtcatgggggaagtgttccttgagccaccatgttggagaggggacctatagacacttggacctatagtcccagctgagctcagccttgcagccacatccactgaggtgtcaaatattaggttggtgaaaacataattgtggtttttgcatttttgaaatttgccatttgatattggaatacattcttaaacaaaagtggttatgttatacatcatgttaatgtacatttatgttttttgacactgaattattactgttaattttgtatttattttagactatagaaatagtgtgagacgaaaagcaaatttgagcgattttcttattcgaattc

SEQ ID NO: 13433 - DNA, 2833 bp, Homo sapiens
  misc_feature (220)..(220): n equals a,t,g, or c
gcctaaatgtattgattacttgtccccttcctcctttgtgacaactcagatgtattatatccacatactacttactcctctgaattcctccagggtagttatgcttttgcaagatgtggtaagtctatattgacaaagaaactcccagttatctatcaatttgttcctgaatgaatactgatgaggacattgttgatgatatcctaacgtgtcttttgtntggggaagacctttgtctcagttgggaaagcaatgaggcttctcctaatttggcaagcctttttatgccctaaactcaccaagtcttcccaatctttcctctttctagcttatcctatttctctttaactttctttatacgtatttttatttgtttttagtatgttgtgttttatgtagctttatgaactgtactttttcttctcctcctctttttttcttcatcttttaatagaggaatgtcaattaaaaaaactctttttcaggggaagatagaaagagtaggatatattagtgtgtttgtttcctagagctgctctaacgaagttctacaaaccgaatggcttagaacaacagaacttgattgtcttccagttctaaaggctggaagtccaaaatcaaggtgttggtaaaaccctgctccctaaatatattggggaggatctgttccaggtctctcactttctgtcttcttcttctctttgcctctcatagcttcaggtgttccttgacttgtagatgtctgtcttcttccttcctttgtgtctcttcacatcatctttcctctccatctccctgttcagattttccttgtataaagacctcagtcatgttgaattagagcccaccctaatgacataattctatgattacctctgttaaaaccctatttgcaaataacgtcatattctgagacactgagggtttaggaattcaaaatatattttttgaggggcagacatttcaacccacaacaagcagacacaatgaaaaaattaaagcaaactggattttaaaagatagagatgagatcttctaggcccttcaaagagaacttcagtgagacaactagttgaagacagtgtttaggctgtttttctatcatgcaaagaattccttctttgtatttatattttgctgctccatttctctttgacttttcctttcctttctttttcttctctcttctattttttaagagggaatataccctcttggtaaaaaattcaaaaggtctacaaatttaaatttacatattttacaaagtaatgcaatatttattcattttataaatataaaaaaattaatatgtaatcattttagaaaagttttaaaaagcaccgttaaaaaagcacaacaaaaacaataaacttatgcaaaatttcaaacctaacagatcatctctgacaattttaggatttatatttttgttttatatatacaatatagttggatattttatacaattgatattatttcatatacccattttctagtccttttagcactaacaagcatactatgaatattttctcctgtcactaaatatccttcacagcatgagtttttgcagtgttctatgaaataaaataccataaaattttcaaagtcttttgtggtatatttagattgccttcaattttacagtaccatacaaataattctgtgatgaacatatttgtaagtaaatctttatttaactccttgactactttttaattttcttctagaaatgaaactgctatattaaagtgtaaatacattaaaatactctggataaatgtcaaataaattatagccaaacatccatcatggccactaaaaaagtctcaataaactatttattaaatgtctagttttatcacatgtgactttcctagtttgccatctgagacaacctaattaaaaattactcccttacgtattatagctacataagataattagctacaaaatacctatgtctacaaaaatgcttgttttacttcagaaaagtttagacaatatttttttcccacatagtaatctagtgcatgaaaataaaatgtccaaaaaatttatatcagagtttaaatgagtatggtggtttctaaaacagatgcaaatccttttaactttcctcccattgaaaagtgcagtctatctttcctttccttctccctggtagacttgtgaccaattccaccaataaaggatggtggaactgacactgcaacttctaaggtgacactatgcaaaggccacttggtttgcagcttccaccttgctttagtggaatacttggttgtcatgggggaagtgttccttgagccaccatgttggagaggggacctatagacacttggacctatagtcccagctgagctcagccttgcagccacatccactgaggtgtcaaatattaggttggtgaaaacataattgtggtttttgcatttttgaaatttgccatttgatattggaatacattcttaaacaaaagtggttatgttatacatcatgttaatgtacatttatgttttttgacactgaattattactgttaattttgtatttattttagactatagaaatagtgtgagacgaaaagcaaatttgagcgattttcttattcgaattcaaaatgggtcataaagtggcagagacaactcgtaacatcaacaatgcatttggcccaggaactgctaacgaacgtacagtacagtggcggttcaagaagtttcacaaaggagatgagagccttgaagataaggagcacggcagccggccattggaagttgataataatcagttgagaccactcatcgaagctaatctacttacaactactcga

SEQ ID NO: 13434 - DNA, 2833 bp, Homo sapiens
gcctaaatgtattgattacttgtccccttcctcctttgtgacaactcagatgtattatatccacatactacttactcctctgaattcctccagggtagttatgcttttgcaagatgtggtaagtctatattgacaaagaaactcccagttatctatcaatttgttcctgaatgaatactgatgaggacattgttgatgatatcctaacgtatcttttgtatggggaagacctttgtctcagttgggaaagcaatgaggcttctcctaatttggcaagcctttttatgccctaaactcaccaagtcttcccaatctttcctctttctagcttatcctatttctctttaactttctttatacgtatttttatttgtttttagtatgttgtgttttatgtagctttatgaactgtactttttcttctcctcctctttttttcttcatcttttaatagaggaatgtcaattaaaaaaaatctttttcaggggaagatagaaagagtaggatatattagtgtgtttgtttcctagagctgctataacgaagtactacaaaccgaatggcttagaacaacagaacttgattgtattccagttctaaaggctggaagtccaaaatcaaggtgttggtaaaaccatgctccctaaatatattggggaggatctgttccaggtctctcactttctgtcttcttcttctctttgcctctcatagcttcaggtgttccttgacttgtagatgtctgtcttcttccttcctttgtgtctcttcacatcatctttcctctccatctccctgttcagattttccttgtataaagacctcagtcatgttgaattagagcccaccctaatgacataattctatgattacctctgttaaaaccctatttgcaaataacgtcatattctgagacactgagggtttaggaattcaaaatatattttttgaggggcagacatttcaacccacaacaagcagacacaatgaaaaaattaaagcaaactggattttaaaagatagagatgagatcttctaggcccttcaaagagaacttcagtgagacaactagttgaagacagtgtttaggctgtttttctatcatgcaaagaattccttctttgtatttatattttgctgctccatttctctttgacttttcctttcctttctttttcttctctcttctattttttaagagggaatataccctcttggtaaaaaattcaaaaggtctacaaatttaaatttacatattttacaaagtaatgcaatatttattcattttataaatataaaaaaattaatatgtaatcattttagaaaagttttaaaaagcaccgttaaaaaagcacaacaaaaacaataaacttatgcaaaatttcaaacctaacagatcatctctgacaattttaggatttatatttttgttttatatatacaatatagttggatattttatacaattgatattatttcatatacccattttctagtccttttagcactaacaagcatactatgaatattttctcctgtcactaaatatccttcacagcatgagtttttgcagtgttctatgaaataaaataccataaaattttcaaagtcttttgtggtatatttagattgccttcaattttacagtaccatacaaataattctgtgatgaacatatttgtaagtaaatctttatttaactccttgactactttttaattttcttctagaaatgaaactgctatattaaagtgtaaatacattaaaatactctggataaatgtcaaataaattatagccaaacatccatcatggccactaaaaaagtctcaataaactatttattaaatgtctagttttatcacatgtgactttcctagtttgccatctgagacaacctaattaaaaattactcccttacgtattatagctacataagataattagctacaaaatacctatgtctacaaaaatgcttgttttacttcagaaaagtttagacaatatttttttcccacatagtaatctagtgcatgaaaataaaatgtccaaaaaatttatatcagagtttaaatgagtatggtggtttctaaaacagatgcaaatccttttaactttcctcccattgaaaagtgcagtctatctttcctttccttctccctggtagacttgtgaccaattccaccaataaaggatggtggaactgacactgcaacttctaaggtgacactatgcaaaggccacttggtttgcagcttccaccttgctttagtggaatacttggttgtcatgggggaagtgttccttgagccaccatgttggagaggggacctatagacacttggacctatagtcccagctgagctcagccttgcagccacatccactgaggtgtcaaatattaggttggtgaaaacataattgtggtttttgcatttttgaaatttgccatttgatattggaatacattcttaaacaaaagtggttatgttatacatcatgttaatgtacatttatgttttttgacactgaattattactgttaattttgtatttattttagactatagaaatagtgtgagacgaaaagcaaatttgagcgattttcttattcgaattcaaaatgggtcataaagtggcagagacaactcgtaacatcaacaatgcatttggcccaggaactgctaacgaacgtacagtacagtggcggttcaagaagtttcacaaaggagatgagagccttgaagataaggagcacggcagccggccattggaagttgataataatcagttgagaccactcatcgaagctaatctacttacaactactcga

SEQ ID NO: 13435 - DNA, 807 bp, Homo sapiens
gtccccactgtgcctatggctcatctagcctgcttccctcatttttgtgacctgcctggttcccatggggaactgagtttgcaatccggggagcaatactggctgaattcatgttcatattgagagcattctgagtagctggcagggccacacagaccttagcgggaagacagggacaccactttccaggatgatccctgtgaaaactgccatgtttgcactgccctcctctgtgagacatggtttagctcaagtccttgctctggtaactttccaacatgtgactttgggcacatgtgaccttcacctctctgggtttgtttcctcactgcttacgctgcaggcaatgcacatacaatatttgctactttagggctatgagatgcactagttagttgtgtccaagtcattccttttaccaacagaaatgaagagaaagaggagaaaaaaataaataaaaccaaaaacctcatcactcttttctccaaaatgagcatttatcgccctctggtgtccaccacagcgctcagtgcagccaattaagagcggcttgaaggccgggcgcaatggctcatgcctgtaaccccagcattttgcgaggttgaggcgggcagatcacctgaggtcaggagttcaagaccagcctgggcaacatggtgaaaccctgtctgtactaaaaatacaaaaattagccgggtgtggtggcatgagcctgtaatcccagctactcgggaggctgaggcaggagaattgcttgaacccaggaggtggaggttgcagtgagccgagatcaccccactgcgctcc

SEQ ID NO: 13436 - DNA, 1120 bp, Homo sapiens
caggatagtcctcagcaagattccgtgtcattgtgttcacaagcacactagaattgtaacaagtctcagatttgggttaaggagagatgataactgtgtctgtaggatttgcccttcctctgtcttcacaccccattcactctgagacaaaggaggtacttccagggctgctggaccagcagggatgggacctcgcctctgccctgtcttggggtcagcctgcccagcgagtaccctctgctggctccttctggcatcttactgggtcctgccgtgcagggacaagcacacgggccctgaaaagctgggtcgacatgagcaggtagcagggccttcctggacctcctttgtttcagatcccaccatcattcagggcccaatttaaaggcttctcttccgtaaagtctcccatcactccaaccatggaatccctccctcctgtcactcttctttttttttctttaacaaatacagttttatttatttacttatttatttcacaaactcttatgtagctcttcctatctctgggcactgttttaagtgacaagtattaactcatttaaactgtcacaacaggccaggcactgacgcatgcctataatcccagcactttgggaggcagaggtggccagatcaccagaggtcaggacttcgagaccaccctggtcccaggagacctcaacttctccagagttctagcctcttcttaaagggccagagtcatgggaacccagatggggtgagggggtctcctgccacggcctccttacaatgatatgacttggcataaatttggatactacctccaaatacagatttatggtctggcgtgatagctcatccctgtaatcccaacgctttgggaggccgagggaggcagattacctgaggtcaggagttcgagagcagcctggcaacacggtgaaacactgtctctactaaaaatacaaaattagccggatgtggtggcaggtacctgtaatcccagctacacgggaggctgaagcaggagaattccttgaacctgggaggtggaggttgcagtgagttaagatcgcgccaaagcactccagcctgggcaacagagtgagactccatctcaaaaaaaaaaaaacaa

SEQ ID NO: 13437 - DNA, 310 bp, Homo sapiens
tgaaacccattctgtgctatttccccacttccggaaagcatcatggaaatagatgtactcagcagctggcagaatcccacggcatctgccttcactcttggcaaggggagcaccggtcggtaggactcttggttgaatcagtccagctccgtgttcttcctacagtccagctattggcctagctgcctctttcacaggcaggcttcccgctccactccactcaaggctgcctcactcactccagtcactcctccagtctccaggtctggagcggggtgggctgtcttccaccctccgtgggcctccgtct

SEQ ID NO: 13438 - DNA, 2109 bp, Homo sapiens
atctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagaggtgaggacggggcacgaggtgtggccacttggcacctggaggggatgggagggtgttgagggagtaggcaggatcccccaggagagtgaggaagggtggcctcagcggagatcaccattgtggctgctttactctgagacctgagcgccctctgcagagaaggaccacctgggggagaagaataccccagcatcagttgtcacaggctgttggtgcgctgtccgcttacccagcaggagcagacgatgaagggttgtgcgacagggaccttgtgtccctgcacagttcccaaaggacagctggaaatgtgacccaactctgaaaagcacatgcagtcagcgacacatttgcaagcatgtttggtttattttgcaacagaaagggtaacaattttaaaaagcttccaccaaggtagaaaacctgccattatcctaagtcatctatacattagtcacattatacttatgtgaaacaccccccctctgtggggggggtgtatgtgtatgggggtgtgtgtatgagtctgtgcgtgtgtatgagtgtgtgtgtatgtgtgcgggggtgagtgtgtgggtgtgtatgagtgggggtgtatgagtgtgggtatgagtgtgggggggtgtatgagtgtgtatgagtgggggtgtgtatgagtttatgggggtgtatgagtgtgtgtgtatgagtgcatgtgtatgagtgtgtggggggtgtatgagtgtgtgtatgagtgtgggggggtgtatgagcgtgtgagtgtgggtgtgtatgagtgggtgtgttgggtgtgtatgattgtgaggggtgtctgggggggatgtgtgcgtgggtgtgtgtgtatgagtgtgggtgtgtgggggtgtatgaatgggggtgtgtgtagggatgtgtatgtgtgtgtatgagtgggggggtatgggagtgtgtggggggtatgtgtgtgggtgtgtctgtaggagtgtgtggggtgtgtttgtgggtgtgtggcggtgtgtgtatgagtgtgtgtgtatgagtgtgtatgtggggtgtgtgtgggtgtgtatgagtgtgggggtgtatgtgggggttgtgtatgtgtgtagggggtgtgtatgaatgtgtgtgggggtctgtgtgggttgtgtgtatgtgtgggtggtgtgtataagtgtgtgggggtgtgagtgtgtagggggtgtgtggggtgggtgtgggtgtgtgtggggtgtgtgtgtgtgtgtgaaagagtgtgagtgtgtgtgtgagtgtattcctgaaatgcagatgaacatcttcccatataaagtaacagccccatttcaatgggccgatttcttttttcttttcttttcttttcttcttcttcttcttttttttttttttgagacagagtttcactcttgttgccaggctggagtgcaatggcatgatcttggttcactgcaacctccggctcctgggttcacgcgattctcctgcctcggcctcccaagtagctgagatgacaggcacccgccaccacgcctcgctaatttttgtatttttagtagagatggggtttcaccatgttggccaggctagtcttgaactcctgacctcagatggcccacccgcctcagcctcccaaagtgctgggattacagatgtgagcccactggccgatttcctagaacaagtaaagtagtccaaccacagcaggcttgacccagcctctgacaaagagcaaatgccctatctgtctcttcttgattcgcttttctttctcctcctcttcctttttcctgtatccatcaaagggtctctgtgatttctgtgttcaggaaacagcgaatatcttgtgagtgggtgggaatagcaactgggaagaggagagggagggataggagaagtgaccgatcatttctcaggggctgatgccctgtgccaggtaaaacctcagtacttagtgcactgtttgctgacgcggcatgagta

SEQ ID NO: 13439 - DNA, 1708 bp, Homo sapiens
aaaacattgatgcatgggtaaaaatatcttttttatatcgcaaataaattgagcttgttatagtcccctctcttcattttcaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacccccatttctttaaaaaaaaaaaaagtctctgcttcttcatttcctcttttaatatcgttaccttgctttatattttctggatgttgatcactatctggaattataaatttattttttagttattatttgtctcctccctctagaatgtaagcttcatgagtgcaaggacttggttttgttcttgctgtatccgtaaagcctagaccagtgcctgacatatggcaggcacttaataaatatttgaataccaaagttaatgttatagtagtgaaggagaaattatttcaaccaaaagtatttcagtaagccatgtatcccacattatgcaagaattgggagagaaatggaaaagtacagcttacagtctgtgttcttaatcagttgtcagaatgagtgccatagatagtatatgttgaagcaattgaaagaaaagaaaatatctgtgggcttgtgggagcttcatgaaaaagatagaaattgagcaagacatagaagtagaaattaagcaaggtactacttggatttagttgatgtacaagagaggaaaggtttctgtttacacttcatctttgactggtcatgtagtttaaagcttcatgagttaatataagtatcagaataggaagtggccaatttctgtgtgaaatatgaaaatcttgcttagaaaggtcttcttgtgatgtctatgtatgtataattcataaatacacagatcattccattgtgtgaagagaaagaaatagttatggaataacctaaattatgtcagattaaaattctaatgaaagccaggtgtgctggcttatgcctgtaatccttgcactttgggaggccagtgcaagcaaattgattgagcccaggagtcaaaaacgagcctcagcaaggtggaaaaaccctgtctctacaaaaaatacaaaacttagcagggaatggtggcatgcacctgtagtcgcagctacttggggaactgaggagggaggatcgcctgagcctgcagtgagcctagatcgcagtccagcctgattgacaaagtgagactttgtctccaaaaaaaaaaaaaaaaaaaaa

SEQ ID NO: 13440 - DNA, 118 bp, Homo sapiens
cctcagcctcccaagtagctgggattacaggcatgcgccaccacgcctggctaattttgtatttttagtagagacggggtttctccatgttggtcaggctggtctcgaactcccgacc

SEQ ID NO: 13441 - DNA, 411 bp, Homo sapiens
aaaaaaagtgagactctgtctccaaaaaaaaaaaatctaatagagcatatggtacaaaactaatttaagactaactgttccgaaaattacatttcaaattttgtggatctgacttacattgatgaaaataaaatcaactgttacagctttacagtgtggcttgaaactaagcagaaatttcttatatctacaagtttctcaagaaaaagcttaaattactaaatctagagtcaattgatcttgaaaaaaataataaaatacaatgtattttggccaggcgttgtggctcacacctgaaatcgcagtactttgggaggccgaggcaggcggatcacaaggccaggagtttgagaccagcctggccaatatggtgaaaccccgtctttattaaaaatacaaaaattagctggg

SEQ ID NO: 13442 - DNA, 622 bp, Homo sapiens; identical to SEQ ID NO: 10216

SEQ ID NO: 13443 - DNA, 926 bp, Homo sapiens
tgcagaaaatacaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatgaa

SEQ ID NO: 13444 - DNA, 143 bp, Homo sapiens
cccagcactttgggaggccaaggcaggcggattacgaggtcaagagatggagaccatcctggccaacatggtgaaaccctgtctctactaaaaatacaaaaattagctgggcgtagtggcgcgtgcttgtagtcccagctact

SEQ ID NO: 13445 - DNA, 3698 bp, Homo sapiens
gaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctgaa

SEQ ID NO: 13446 - DNA, 3698 bp, Homo sapiens
gaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttaaatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtacccttctttggaaaaaatggaaaatgggttctgatatgtgatctcaaagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctgaa

SEQ ID NO: 13447 - DNA, 119 bp, Homo sapiens
ggtggatcatttgaggtcaggagttcgaggccagcctggccaacatggtgaaaccctgtcactactaaaaatacaaaattagttgggcgtggtggtgcacacctgtaatcccagctact

SEQ ID NO: 13448 - DNA, 4175 bp, Homo sapiens
tactttcagagaaaatctttccaaagaccctcttaagaaagtcctatttctaaaattttcatgtttgattcattcagatatgattaaagcccatcatggtctgtgtaaatgtttctgcattcttagaaactttctccagttttttataactagtccattggatgtaggaatgccaaagagtctaactaaaaagagagggaatcttggctacaatggaatacctaggggtatgggaagtaagtaatagtctttatttccatatgaatattgctggctttacacctgcaataattaggcaagagactcaaagatagttttttcagaaaagttttctttcaaggatctagcaagtctgagctatgcttccaactttactgccctccatcatccggcatctttgactcatccaccaccttctgtccctttcattctcattccccatgtgtcagctccccagaaaggacatatcttgtacaccttgccacagcactcatcacctgcttctggactgcctgagcaagagtgatacttcctgttctaaagacaggagtgaggatgggggatactcagactttgggatgtgccagaactgtggctagtccccaggaagcagaacttggaggactcataaaggagccaatcccacctccatcctaaacaaggccagttcataaaccccatctggcacagcagcagtctcaggaagctaaattggggagtgccctgtatctcactccctaaactggggagtgagagcatcctgatggtcagctcttgggctgtgacagtggtcccctgcaaatgaaaaggggagctgtactgatgtcaggagatgtggctcaccgtcattattagagtcagggcctctcctgcctacttcggtgggtgaggacagagagggggatggagagaatccttaatccttcattggtaacatcctgagatcctcctagagttccagacatcatacttatcatgggatttgtttgccttattttagcctccctgccctctggccagtgagttgaattaaataattgtgccctcagtatcaaggagtagacaatgtagactatttttatgcagccctgaggacccccagtcatgactcttgataaggtgaggcatctgggttgggtgctaaactatgagccttcttcaccctccttccagtaatgcctatttcagccctgcctagcctgcaccatcttgataattaggtaggatgactgcagattgaaatcaagcagctatttcctttggcttttctggcagacactgcccactgcctccagtgcgtgcactgtagatggtgggtggtccctatgggtgggtgctagggggaaaattccacccctgcagtaagcagaagcaggcagaagtctgctggaagctgcaggcctcccgcactgacttgcaatgttccttgtgctccaggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggacccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaa

SEQ ID NO: 13449 - DNA, 4174 bp, Homo sapiens
tactttcagagaaaatctttccaaagaccctcttaagaaagtcctatttctaaaattttcatgtttgattcattcagatatgattaaagcccatcatggtctgtgtaaatgtttctgcattcttagaaactttctccagttttttataactagtccattggatgtaggaatgccaaagagtctaactaaaaagagagggaatcttggctacaatggaatacctaggggtatgggaagtaagtaatagtctttatttccatatgaatattgctggctttacacctgcaataattaggcaagagactcaaagatagttttttcagaaaagttttctttcaaggatctagcaagtctgagctatgcttccaactttactgccctccatcatccggcatctttgactcatccaccaccttctgtccctttcattctcattccccatgtgtcagctccccagaaaggacatatcttgtacaccttgccacagcactcatcacctgcttctggactgcctgagcaagagtgatacttcctgttctaaagacaggagtgaggatgggggatactcagactttgggatgtgccagaactgtggctagtccccaggaagcagaacttggaggactcataaaggagccaatcccacctccatcctaaacaaggccagttcataaaccccatctggcacagcagcagtctcaggaagctaaattggggagtgccctgtatctcactccctaaactggggagtgagagcatcctgatggtcagctcttgggctgtgacagtggtcccctgcaaatgaaaaggggagctgtactgatgtcaggagatgtggctcaccgtcattattagagtcagggcctctcctgcctacttcggtgggtgaggacagagagggggatggagagaatccttaatccttcattggtaacatcctgagatcctcctagagttccagacatcatacttatcatgggatttgtttgccttattttagcctccctgccctctggccagtgagttgaattaaataattgtgccctcagtatcaaggagtagacaatgtagactatttttatgcagccctgaggacccccagtcatgactcttgataaggtgaggcatctgggttgggtgctaaactatgagccttcttcaccctccttccagtaatgcctatttcagccctgcctagcctgcaccatcttgataattaggtaggatgactgcagattgaaatcaagcagctatttcctttggcttttctggcagacactgcccactgcctccagtgcgtgcactgtagatggtgggtggtccctatgggtgggtgctagggggaaaattccacccctgcagtaagcagaagcaggcagaagtctgctggaagctgcaggcctcccgcactgacttgcaatgttccttgtgctccaggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaa

SEQ ID NO: 13450 - DNA, 119 bp, Homo sapiens; identical to SEQ ID NO: 13447

SEQ ID NO: 13451 - DNA, 917 bp, Homo sapiens
gagtacagtagaagaaaagtaagatgggaaggcattggcctactcacctgctttccagtttgggctagaagcagtctcaggtatgagaaaagaacatgaaagggctacagaaaagaactgagaaggaacagtgtgcaggtgagaattcagttttgactctccacgtcagcacgagtttggccaatgatgaaatggcgtaatgagtgaaaatcccttactggcaaaatcaccagaaagtaaattctgtttttaggggtgctgttgtgctgcttagttccgtgtaatcaggctactctcttgggacagccattgtaaacactgccttcctgataaggatatagcaagttgtatagagtcaaagccaatttgtttaacagagccattcagaagaccctgtccattttttgttcttttaatgaagaaagtaacgttttgaatgtagtgtttatgtatagtgactatattggaatataatgtgtaatgctttcaataaacccagaaacttttccaaaatattgtcttggttcataggatgtgatatggaaggatagacaccgtcttaatattttcccccaacagaatgtcaattcttagagtaggggtggggcaggaaagtgggctataaaatcactggctataaaatcaacttttcccctttgaatctcagaattcagtgtcttctagggcagatctctactcatcatctctacctgatatgaccgcacacgtgagtgcctggcacctgctctttctcttgctctgatgaccacttcctttctgcccatctgttttgacctcgcaccattctggagcttttaggaaaggcatttgtaacaaaggcaggacccaggtctcctggttttcatctccgtattgttttcactatattataaaaccttctttacttaaaaaaaaaa

SEQ ID NO: 13452 - DNA, 391 bp, Homo sapiens
tgatctgttctgtctgtgtcctttaatataaatgtttaaatgtttaaatgtcattgggtacttggttataggaggaggcagagctctgagtggaatccatgatggtcctgagaccagagatatgtatttttttcttttcatgtatgtatgtcttatatccccaattgagaattctatcactgtgagtgatacagcttcagaatcctgaaggctaagctattaggtttgaacaatatgaaattgctggtttgcaactatattatatctacaaaagggcaagttcatatagcttaacctaaaaagtaaaaatcaaatgacatcaggtatgtgcaaaaatgtcataaatggctggtgaatatataagaagttcaacattactaagagccaaaaa

SEQ ID NO: 13453 - DNA, 577 bp, Homo sapiens
aggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcaggtgagccccacagaggcgattccaagaccaggggcctgaaaccccactccccagacggaatgcccaggctggccgagcctcagtctccccatttctcccacccagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgctgcc

SEQ ID NO: 13454 - DNA, 282 bp, Homo sapiens
catggctgtaatcccaacactttgggaggctgaggcaggcagatcacgaggtcaggagatcgagaccatcctggctaacacggtgaaaccccgtctctactaaaaatacaaaaaaattagccaggcatggtggcgggcacctgtagtcccagctacttgggaggctgaggcaggagaatggcatgaatccgggaggcagagcttgcagtgagccaacattgtgccactgcactccagcctgggcaacagagcgagactctgtctcaaaaaaaaaaaaaaaaa

SEQ ID NO: 13455 - DNA, 1352 bp, Homo sapiens
atcagtacttcattttttttgtgactgaataatattccgctgtgtagatatatttcacattttgttcaccatttatccgttgatggacacttggtttgtttccaccttttggctattgttaacagtgctgctatgtacattcctgtctaagtctttgtttggaaacctgttttccaattctttgaaatatctaggaatggaattgctgagttttatgataattcaaagtttaccttctagaggaaccccagcaaccgtattgttttacattcttatcagcagtgtttgaggggtccagtttctccatgtcctcaccaacacttattttttattatttcctgattattattattattgccatactagtgggtgtgaaattgtatttagttgtggttttgaattccatttctttaatgactcatgatgttgagtatcttttcatgtgcttattggcgatttacatattttctttggagagatgtctgttcaagcccctttgcctatttttttaattgggtggtttgtctttttgttgttgagctgtaagaattctttatatatctggttactagaccctcatcagatatatgatttgtaaatattctattctgtagattgtcattttattttcttcatagtgtcctttgatacacaaacgttttaaattttgatgaagcccaatttatctctgttttcttttgttgcttgtgctcttgctgtcatagctaaaattttatcaccaaatccaaagtcatgaagatctcccccatattttcttctaagagttttatagttttcgcttgtacatttatattttatatcctctaaattttgtttataatttaaatcattgctatagacttggtccagtgagacctataaacagaggtcttaatttactcagtggttaaattgtcctaaaattgatttctgcaaaattcagaggggagatttttgggatttcatagagaaatctatatccatacagttaaatccttcatgatttcatacacttcacttttttaaagtattaaaacttttttatttgaagaatacgtggggagaagagaaatatatttcagcacttagatatgtagattatttccaaaatagtttaccactcaactagtcacttctgtgtaaatcagttttccctgaagcaagcattgtgttgttcccggctacaagcggtcctcattttgcatggtactgtgggaccataaaaatggccatgcaaagcaatcttaataatcaatggggaaaatgatgattgttccatgacctttaaaattctgctaaaatattaaaactcttaaggtcagttataaatgtagaaaaaaatgcaaaaaaaa

SEQ ID NO: 13456 - DNA, 266 bp, Homo sapiens
ttgttgttttttgagatggagtcttcgctctgtcgcgcaggctggagtgcagtggcgcgatctcagctcactgcaagctccgcctgccgggttcacgccattctcctgcctcagcctcgcgagtagctgggactacaggcgcgcgccaccgcgcccggctaattttttgtatttttagtggagacgaggtttcaccgtggtctcgatctcctgacctcgtgatccgcccgcctcggcctcccagagtgttgggagtacaggcatga

SEQ ID NO: 13457 - DNA, 12586 bp, Homo sapiens
tagtttgataccacagattatccagcatgtttataatgaattatttctcctccttcaatttcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggtacaagcggtcttccgaattttgcactcagaaaagtggcatcatctaagtcaattacatgcaaattctggggggctagttttttgtgtatgttaaatgggtcacaacacgacttctgtaaatcctcaaatctgtcaatataaatttttatgtgatgaaagcaaattgtattgttcctagaaagtgtccttccagttctaagttgaagtaaaagcatgtcatttgatgacaattcttgcaacatcttaaaacctgtgtgacaagtatagtaggttttatggcactcatttgtagtacgaagctggactgcaactatcgatccatcattgttgattctagcatattttccttgttttattttgtctagagatctaggtcacgggctgatcacccttagcttgagctctcctccgcctggcttccggcaggatccacgtccacacaggcacacttgcctgcccgttcatttcccagcctgtccccatgctaccactccacttcacttattatatatactctaaatctttttcttctcaacataaaacattctacaatcctgcagcctttttacttttttaagcaggtaggcaaacatgtagttgatactcagtggaagcacagagcagagttaaagagaaggaccccctttcactgaccagttgagttttttttctttcctttattttttaaaacaatttcaaaattgagatggggtttcgccatgttgcccaggctggtctcgaactcctgagctcaggtgatccgcccaccttggctgggattataggcgtgagccaccacacctggccaagttgagtttttaaagtagaaaattttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaattaaaaaaaaaagaaaaaagatatgaccttataaatgtaagctgggggaatggcaactctggcacaactttgaggtcaacactttagttttgtgagagtgctcttggcataaagtgggaaccatggtggagccacagttgactccagagagaaaagagggtagaaacctttccatgcttcaacaagacatgctgctttactgtttgaggtgactgcttaaatgctatattgaatgtaggttcaaaccctcaaaggtagtcataggaggtagtgatgactagagtacttgtttttagatagtgcatgagttgtataatattttatgaatattctctttgtaatcaggtttacatttcaagttataatagatggaagagaatttccagaaggtgaaggtagatcaaagaaggaagcaaaaaatgccgcagccaaattagctgttgagatacttaataaggaaaagaaggtgagtgattgccttttttcctaataaatgggaacttgcaaatacattttctgtttctctctgtgagaaaatactttcatacagagtaaagccattcacacgttcccttacattcaagagtttggttaagtcattcaccctatcttcatttctatgaaaccctgagtgagagccacacctaggacaccatgggcaaagctggataatagttatttagagtgtcagcagcagttaaatactctaaagttgaacaaatatggaaaggtgagaagtgttcagtgggaaatgagctgacaggttctgggaggagtcccctccacctaaatgaggaagtacagtaaaaaaggaaaaagagatgaaagtgattgtagggagaataatgtacagtggtcactcactctctgtggggaattggtaccaggactccctgtggatgccaaaattcactgatgctcaagtcctttatataaaatggcatagtatttacatataacctatttacatcttcccatatacagttatgcattgcttaacaaggagaatacattgtgagaaatgcacctttgggcaatttcctcattgggcaaacatcatagaggtacttacacaatcctgaatggtacaaccagtacacacctaggctgtgtagtatagcttattgctcctagactacgaacctatacagcatattattgtactgaatactgtagccaattgtaacacaatgtttagtattcatgtatctaaacatatctaaacacagaaaaagtacggtaaaaatacagtataaaagacaaaaggctgggcttggtggctcacacctgtaatcctagcactttgggaagctgaggcgggtggatcacctgaggtcaggagttgaaaaccagcctggccaacatggtgaaaccctgtctctactaaaaatacaaaaaattagctgggcgtggtggtggacgcctgtaatcccagctacttgggaggctgaggtaggagaattgcttgaacccgggagaaggaggttgcagtgagctgaggttgtgccactgcactccagcctggggatcctatctcaaaaaaaaaaaaaaaaaaaaaaaaaaaaaaaaaaaaaaagacaagcaaaagtacacccatataaggcacataccatgcataaatagagcttgcaggactggaagttgccctgagtttgtcagcaagtgggtggtgaatgaatgtgaaggcctagggcattattgtttaccactgtagactttataaacactgtatacataagcaacattcattttatttaaattttttttcttcaataataaattaaccttagcttactataactcttttactttataaacttcttatttttaacattttcactctttccaaataacacttagcctaaaacacaaacgcggccaggcgcggtggctcatgcctgtaatcctggcactttgggaggccaaggcaggcagatcacctgaggtcaggagtttaagatcagcctggccaacacggtgaaaccctgtctctactgaaaatacaaaaattagccgggcatggtggtgggcacctataattccggctacttgggaggctgaggcaggagaattgcttgaactcaggaagcggaggttgcagtgagccgagatcgtgccactacattccagcctgggcgacaaggcaagactctgtctcaaaaaaaaaaaaaaaaaaacccacaaaaccacaaacaaacacatagtatggctgtacaaaaatattttgtttctttacatgtttattctataagcttttttctatttttaaaattttaaacttttttttttaacttttaaactttgttgtaaaaaattaaatcatggttgggcatagcggttcatgcctgggatgtcgaggagccatgattgtgccactgtactccagcctgggtgacagagtgagaccctgtctcaaaacaaaacaaaacaaaacaaaggctgggtgtggtggttcatgcctgtagtcccagcactttggtaggtcaaggtaggtggatcacttgaatttgggagtttgagattagcctaggcaacatggtgaaaccctgtctgtactaaaaacacaaaacattagccgggcttggtggcatgtgcctgtagttccagctactcaggaggctaggcgggaggatcacgtgcctgagaggtcagggctgcagtgagctgtgatcttctgactgcactccagcctgggcaacagagcaagaccctgtctcaaaaaaaaaaaagaaagaaaaaaaattacaacacaaacacacacatcagcctaggcctacacagcgtcaggatcatctacatcaccatcttccacctccagattttgtccctctggaaagtgttcaggagcaataacatacatggaggtgtcatctcctattgtagcaattccttcttttggattacctaccgaaggacctgcctgaggctgttttacagtttacttttttttttttaagtagaaggagtaacttctaaaataatgataaaaaaagtatagtaaatatataaaccagtaagttacttatcattatccagtattatgtactatacataattgtgtgtgctagacttttttataagactgtagaacagtagatttgtttacagtagtgtcaccacaaatgtgtgagtaatgcattgtgctgtaacccaggagtttaaaattatcctgggcaatatggcgaaatgctgtctgtactaaaaatatgaaatttagccattacagtggctatgacctcattagatgacagtaattttttagctccattataatcttatgggaccactgtcatatatgcagtccattgttgaccaaaatgtgattatgtagtacatgattatcctttagatcatctctagattacttataatatctctaatacaatgtaaatgctatgtaaatagtttttttgttgttgttgttgtcgttttttgagacagggtcgtactctgtcacccaggctggagtgcagtggcatgatcaagggtcactgcagcctcaatctccccaggctcaggtgatcctcccaccttagcatcccaactggctgggactacaggcacgagccaccacacctggccaatttttgcattttttgtagcgatggagtctcactatgttgcccaggctggtcttgaactcctggactcaagcaatctgcccacctcagcctcccaaagtgctaggattgcaggcatgagccaccacacccagctataagtagttgttatgctgtattgtttagggaataatacaagaaaaaaaatctgcatatatttagtacagatgcaaccatcattttttttccaaatatttttgatccatgattggttgaatccagggatttgaaacccgtggatatagcgagccaagtgtttacagagagcaggtaatggagaaccaatatacatgtgactggtatcccggaaaataagaacagagtaaatagtgcagaagaaaatgatctgaagagatttcagcagacaatgtttatgaaataaagaaagacttgactgcagattaaaacaacttaatagatacaggaaaatttagaaccacccagaccaacattgattcttttttttttttttttttgagacagagtctcgctctgttgtccaggctggagtgcagtggcacaatctcactgcaacctccgcctcccatgttcaagcaattctctgcctcagcctcctgagtagctgagattacaggcacccaccaccacggccagctaattttttgatatttttagtagagacagggtttcactatgttggccaggctggtgtttaactcctgacctcgtgatccactcgctttggtctcccaaagtgctgggattacaggtgtgagccaccgcgcccggccccaacattgattcttatgaaagtactgtgctccagagatgaggaaagaattttataagcatctagagagaagaggaaaactatgtaaaatgtaaaaatttttaaaatttcatgctgtgcacagcaacattataaaccaggagatagtgtagcaatgcttataaaatgaaacatgaagtcatttacattttagacaccagagggccattctcagatttggaaaatgttgggaaaatttaggtttcaaggttctttcttgaaaaatctacttaaagatacccttctaaccaatttttttttaactcaagcaaaagtgcaaagtataattattaatgaggtagaaaattgagtcaagaagttagaaaaaacaaaaaacagaatgttttacccccaaaaagcagaagaaagaaaataacaatggttgaaattactataaaagaaataaaaaataaaaaaaaaagatcaataaaaccaaaagctagttttttgacaagattaataaaatagcaaaactcagccgggtgtggtggctcacacctctaatcctagcattttggaaggctgaggcgggcagataacttgagcttaggagttcgagaacagcctgggcaatatggccaaacgctgtctctacaaaaaatacaaaaaaattacccaggcatggtggtgtgtgcctgtagttccaggtgcttgtgaggctgagacaggaagatggtttgaacccaggaggtcaaggctgcagtgagctgaggttgcaccactgcactctagcctgggtgacaaagtgacaccctgtctgaaaaaaattaaaaaaatatcaaaactttggacaagatttttgtcggactaagaaaaaaaggtagagataataatagtagaaatgatgctattatattcatctttttcattaagttatgatccagtatacagctttactgtaatatctcttgccttgttttttgagattagaaagggtataacaagctagaaagtgttatagtactttccaaggacaaacaagaaaaagtgacttctttcctattgttaaaatctatcttcgtcgatttttttctggtagagggagatacgtagtcacacttttgctcaaggtaatataataggaaaatatataacatccaagttgtctttcaaattgctcatttagtaattttattagaagaatgatttttaaaaggttaaatctttgttgtcatttatattaaacaggaattttttttctttgtaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaagggtaagacataatttggcttttctttctgtttcattgtatttaagcaataaagttggtttattttcgtgtctaattttccagaaatatgtgtccttttaagcattctgtatgcaaggttttacatgattgataagtaattggatttataatttgtaattaaaatgcttaattgctgaagccatggaacccatttaccataattgatcaaattagggtaatcctttatttcagagaagtagctggatggtttagtctgtggaacacccaagagagtacagggtgccactgctcgaagaatacagaaatcttttcatcattgaggacatgatggtggtaactgtctgaaaacctctctgccacatgtatagaatcactcttcacccttgtcagatcagggagctctttgtccaggtatttgtccttcaaatttgattaaatgaacaaataccatgtatcagaaggaatgagctttagccctagactatgaggagaccgggatttgagggatctgatgagacagatgaactagagtttcaaagttactgagaacatcaccagtgagctaagatgtgtggaaataggataaagaatggattggaactgaaaaaagcagaaatcaaatgagtatgaggcaattgtttttcaactacaaccaaccagttaaagagaaagaagaaaaaaaatatctacatggcaaatagtttaaatcatcactttaggatacacttctatgaattgactcagctatttacagtcatggcttttgagccaaaaccaggaagagaaaaatgttatagtattcattggaatgaaatagtcaaaagtgaatctgtgagtcaatctcaataattaagagatgattttattttctgtagctcacttttttggtttctttaaattatgctaacattagatacctaaaagaaagaagaaatctgtttgcgggggggggcagtatctgaaaaaaataggagctatagaaatgatccagtcactcaacccagctatttaattcagggtctagcggggaagactcaccctgtttggatgtgtttctctcgatggcttccaacagaaacataaagcaaaaggagttcaaatactggaatcatttttcagtaatagatagtaaccctgtgatataaattgccatgtccattgttttatcccttaaaaatagttattatataattgtccaagtatccttgcctaaccacaaatgtccttacatctaataggaggagagtgtggactttagtatagggaatctgcactgtggggattttctcaaatttttgtgcacatgagcagatggcagacaatggtgaagttagagcagaatccatgctttgctcttcccctacactataacctcatagcttctcctgtggaagcctactttctctgctggctttttccttcccatttgagcacctctgaaaaaattcactggatctctttctttcttttctacctccgtatcttttgacctttggggaattaaaaaaaaaaaatcaccacttagtgcctttgtgccagatctttcagcaaagcaacaaaaaattagaaattgcctggaaaatgcaagctcagatgtcagctgatcctgggtattcagagaaattggtcaggcatgttactgagggtttaaattatgcaagatatgaactataaatctatctaataaattggtgttatcttaagatctctgttaatatgttattttttttgaatcctaagttggatttgctatatttttcatgtttggataagtaccttctatgatttctcctagatttcattataaatgcaaaatgggacagaaagaatatagtattggtacaggttctactaaacaggaagcaaaacaattggccgctaaacttgcatatcttcagatattatcagaagaaacctcagtggtacgtattgcctttggattaaatttttatgttttaaaattccctctgaagttgacttgaggttagactgtgttaacattatgccaagacagccagtgatttagcaaaatgattcctccattctgtgtcgtaccgatgagccatgcaccatggggccatgaggcctcagagggataaaatttctggtggcaactcagggtagtttttaaactccaggctgggctgggtgtggtggctcacacctgtaatcccagcactttgggaggccaaggcaggtggatctcctgagttcaggagtttttttttttttttttttgagatggaatctcgctctgttgcccaggctagagtgcagtggcacgatctcggctcactgcaacctccgcctcccatgttcaagcaattctcctgcctcagcctactgagtagctgggactacaagcgcctgctaccgtgcccggctaattttttatttttagtagagatggggtttcactatgttggccaggctggtcttgaactcctgacctcatgatccacccacctcagcctcctaaagtgctggggtttacaggcttgagccactgcacctggccgaactcaggagtttcagaccacctggccggggcaacacagcaaaaccatgtcgctacaaaaaaaaaaaaaaattagacgggtgtggtggcatgtacctgtagtcctagctactcaggaggctgaggcgggaggattgcctgagcctgggagatggaggttgcagtgagccaagattgtgccactgcacttcaacctagacaacagagccagatcctgtctgaaaagaaagaaacaaacaaaatatctgccctgtgatccagaaaagtaaaataaaaaataaaataaaatccagaccaaacatccaaaaaatgttattaatcttgtaattgtttatggttgtggatttggtaaatgtgttgaaataaatgtgatagtacatagaaactgagcctctgtagagaaataattagttgtatttaagcctactaagggatactttttctttcagaaatctgactacctgtcctctggttcttttgctactacgtgtgagtcccaaagcaactctttagtgaccagcacactgtaagtgtagacaaacaattgagatacttaacatattcatatttctgtctgaaagacagatttttatgtttaaggagaatttagggaaagaaataagtgataaaaacagaattaataaactaatagttacacccttttcttctagcgcttctgaatcatcatctgaaggtgacttctcagcagatacatcagagataaattctaacagtgacagtttaaacagttcttcgttgcttatggtatcgtattagtctcgaagcttcctacttaatcttatttttctgtgcgtttcctcatttaaaaataacttccagtattccaccataatttttatattttttatcttatgcactcttactaaatgataatacctcagtagactttttttttttttttttttgagatggagtctccctctgttgcccaggctggagtgcagtggtgagatcttggctaattaccacctccacctcctggttcaagcgattctcctgcctcagcctcctgagtagctgggattacatgcgcgtgtaccacacctggctaatttttgtacttttagtagagacggggtttcaccatgttgttcaggctggtctcgaactcctgacctcgtgttctgcccacctcggcctccccaagtgctgggattacaggcatgagccaccgcgcccggctcggcagctttttgactttttttaaaattaagttccattccttacccttccacacgtcacttctgtctttcctcactcatccttatattttagtatattcctatgattttgcttttctctcctaccaatgggataatatttaaagattcactaatatagttcgtttctgtttttaaaaattagaattaaacttaaaagtaaacttgaaatcagataattttttaggctggtgcagtggcacatgcctgtagcctgcagcacttgagaggccaaggtaggaggatcgctttagcccaggagtttgagaccagcctaggcaacatagtgagaccctcatcgcaaaaacaaacaaacaaacaaaaaccagacaatttttttgtgcacataagcaggcaatgttgaacttagagcaaaatccatgcttttggtgattagtgttacaagagtattctgttataaagaactacaaatcaataagaaaatggcaagcagctcagtagaaaagtgtacaaaatgtataaacagatattcagagaagagatacccaaatgggcaacaaatattaaaagctgctttactaggaatcaggaaaatttaaatcaaaacaattagatactattttaaactcattagattggcaaaaagttaagtcttacaatactaagtgttgatacagggcttgatgagagtacagacattgatggactaagaaattggtcagagagccatctagatatacaggaggaaggaaaacgggaaaggaagatgactgatttagtcatctgaaactatttctcattttcttttgttatagaatggtctcagaaataatcaaaggaaggcaaaaaggtgagtatcattatgcattgaacatattttgatctgaagttttatttcagacttatttattgttcttaatacttgtagagtattgtacacccttatttgagcagagtttcagaagcagaaagcttgaaatctataaacaaataattttagatgtgtcgagaaatctttgactatgtgcacatgctacactgtaaacataaagcactttgggggtatcgctagagtaattaggttaagggcattattt

SEQ ID NO: 13458 - DNA, 8462 bp, Homo sapiens
tcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtcggcaccgctgcgttacccggaaccgccgggccgaacagcatgacgtccgctttggagaactacatcaaccgtatcctcaagctggccgccgcgggcgtgagccggggtcgcggagaggccgcggtcggggatcggtgggaggttgggaggcctggcctcggcgggatcctgggggcgggcgaggagatgagggccccggaacgacccagagttcgccggcggcgcctcgagccttcccgctgctgcgggcccaggggtcctttccattttgcctgcaaaacccaaataaaaacccagtgtgattattccgaacttttctgtcttaaaaaaaatgtacgctcttgattcttacttactatttccctatggcataagtgttaaagtttgtgaataagatgaacagtcgtcctggcggcgacaacagttttgcaaatctttgtacttgttttattcacataatttgctcgttcgaggatagcaaaaagtttaacgatggttcacagactgtttctgtccctttaccacttgaagtcccaacttgttggtagaatgaaaaaaaatggttgctgttgtaatggattatagtgaggagcaagtaacaaccccatgggaagtcttaaaatagactttacaagtgttaccgttttaaagtcttaggacaaaaacactacgttaagctcaggtacaaactgggtgacaaaaattaaataccgaatgcttttaatgatgcgttattggtaccctgtgacactgcttatatagtttctttacttttgaattacagaagcctgtcctggaagacagttttttaacatgctggaaaatcgtccaacatcgattaatttagtactcatccacttttcattttagaaataaacaggcctaagaaacgaaatatcctgcctgaaataatagattggtaaccttcctagtagaaaagtgtcaaaaatccaggatattttgagataagatacaccgatcacatacagaaagaggttttctttttctattttttcccttttttaatcatgtaattatcacaaagacaaaaacagaagctttttttaagtttttttttttttttctttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtctaagaaacttttaacgtttttatgtagtgaacttagtggctgtgttgaatacttatacctagttgtcatatttattctaaaaattcaaatcattcccttgccagagtctgttttcaatttgcattccctaagaaacactttctttgattcagttatcaggaactgttgccgttattacatcagatgggagaatgattgtggtaagtctttggaattttcattctctgctttcctgtaggtttattggttgcaagttttatgtgaaacctctaatctctaatgcctagacagcacattacacccgtagtgcaattttattataattcagctctttatcactttgctgtcaatccatgttttcctcactaataaacattgtgtgttacctacaaggtttctcggagctagaataatagattctgccctcagagagctcctagtctgtagacctttattaaacttacttttcttcttccatttttatttccttccccattcagcaccacatgaatcagaatttttttgaaattttgcatatgcttagtaactttttaatgatttagatactattaatatctagataacatttaaggcttgtatacaatcttaatattctttgtttttaggttgtgtgacatgtcttctgtaggacacattatgatgattgactctctatatatacacatatatatgtaaaattggcttgttccttgaagttgtttctcccttgctaatttatgtcatataactaagataaaacgttcctatagtgatacttgtatttggaatttgatctgaggaattcatctcaagatttttgggtacttggttatttcttcacttacaattcatactttgaatgctttcaaaagaattttaaggctactgaactttctctattttctaaccttacctagtttctttaaataatttgatcccttatttttccattcttcagttttgcttttgttcattttctttttaagccttgtgattttttttcactgggtccttagtgactattattagtcaaagttctagctttgtcctttactaaatttatatcatgtgccaggtgcatatatgttacattatttaatgtacagtaaaaacttatgaagaataagtacccctgtattctagattaggaaacaagttcagagaaggtgactcactttctcagagtcacaagggtagcaagtgacagaaccaaactgggatttaaatttggtttgacatcaaagccaaggccagttgcctggcttctttcttaaggaagcaatgatgtttgcttaggcacctcacattgtattttttcaaatatggacagtttgacatattttaatttcaacacttcaggaagcctattgctgttaatagatatttgcatttttttttaatttggtgaaaaccttaagtttaaattttcttatttttgttgacagggtagataataaactgagaaattatttttaattttaaagaagaatgaaagtgatataaaaagcatcttaagttctaaagttcagtagttctgtatttctttgacacataatttatttgatgggataatgtgtaaaatgaagtcaagaagttatgaatggatgtttatgataacaaccatttgctaactagttcaataaatactccatattttgtttctcttccaagttacagatttcattctcattttatttcattctcttttttatttcattctcattttatatattttgactttcagaagataaaacagtttaagaacttgagaggtttaaccatcaaaaccaatgttagttgatatttcttcagaaacttgaataccatgtgagttactctgttatgctagacccatgtcttcttttattcaatactaagctttcataaaactctccctgattatttccttcaagttctggttttaattagtatagtcacatttgtatctaccttactgggagaattaaacaataaatccatatgatacacattaaacaatacatgtgagacacacagaacactggtaactagtatgtactcattaggtgttacatgtaactactagttaaatttttagtatatttatgggactgatttgaatctgaaaaatggcaaattatatttacttgtgtataatagtatagaatgttatggtttagtggtctggctcaggagctagccttttgtggttcatctcctggctctgccacttactacccatgtgatcataagacacaccattctgtgcctcagtttcttctttgaaatggggctaattatagtactaaatcaaagggtagagatgagttgagaaaatgtgtacagtgtgtttagcacactgcctagtgctggcatatagcatatagtgatactattacattgctgtagttggtatgtatggttcttccttatttatgtatatttggctatcattttcccttaaatatcctttgtcttagtttatacctttagctgctggtctacataagcttttatgctacttacttggagatagtcacattagtacataggtgtcctttgcaactgctgtcaactctacatatgagtgagatgtgtggtgcaggtccccccaccccagccaaataaccaagaggtaaattgtgtaccctcgaatactgttggttataaaaaaggcattttatttgccgtcgtataggtacttgtattggaatacctggcaactaaaatgactgtgaggttaaatttacactttcaggtaaaccagaatatttctctttttctcctgaatattttctttacagggaacactgaaaggttttgaccagaccattaatttgattttggatgaaagccatgaacgagtattcagctcttcacagggggtagaacaagtggtactaggattatacattgtaagaggtgacaacgtgtaagtaaaatatatctgttaaaattataaatgatactgccttactttatggagaagaggctttccccaaaataccctactgtattgtccatacatagttaatagaatcttgcattcatttctttcgtaaatataccttttcttatgtttgtgtaaaataaggcatatgtatacattttatgtcagcacttctttaggtttcaaccaaagctgtctctctacaaattaaacttttacctgagatttgcccatttttctactagttaagtagcctgggtagagtccagaaagggctctgccttatattaaatacttcattagagagacttcttaaaacgttctttcaaatacccagaattttagaggaacatatttctagagtccaaggccaaagtttgaaaaatgttttgaaatctctgatttgaacaatattaattcatgctcaataacataggtgtatttataaataagtacttactcgttattcattttcttttaattttttagtatcattgacacacttaagatgtccctgtggcctcagtttacttgggacagacagatataaaagttcaagagtaattggccaggcatggtgcctgtaatcccagcactttgggagtctgaggcaagtggatcaggtcaggagttcaagaccggcctcgccaacatggcaaaacactgtctctactaaaaatacaaaaattagccaggcttggtggcgtgcgcctgtagttccagctacttgggaggctgaggtgggagaatcacttgaacccaggaggtagaggttgcagtgagccgagatcaccctactgcactccagcctgggtgacagattgagacaccaattcaaaaaaaaaaaggccgggcacagtggttcaagcatgtaatcccagcactttgggaggtggaggcgggtggatcacttgaggtcaggagttcgagaccaacttggccaatgtggtgaaaccgcgtctttactaaaaatataaaaattagccaggcgtggtggcgcaagcctgtaatcccagctactcgggaggctgagtcaggagaattcgcctgggaggtggaagttgcagtgagccgagatcgcagcactgcattccagcctgggcaacaagagcaaaactccgtgtcaaaaaataaaaaagaaaagtggctaatgtggttcacgtgccgtggctcatgcctataatctcagcactttgagaggccaaggtgggtggatcacctgagcccaggagttcaagaccagcctggccagcatagtgaaaccccgtctctccttaaaatagaaaaattagcctggtgtggtggtgcatgcctgtaatcccagctacttgggaggctgaggcagaagaatttcttgaacctggtagatggaggttgcagtgagccaaggttgcgcctttgcactccagcctgggcaaaaagagtgaaactccatcttgaaaaaaaaaagaaaagtggctgatgtgacagaggaactgaattttaaattttatttaattgtaattaattttaatagttacatgtggccagtattagtatagttatagaggctagaagaatgccaaatcagttttctagtgagtactacactgaatcaaaatatagttggaaagaagcaaaagatacattagcaattttaagctagaacatttaacaaattctaggggactaactgtcccctggaataacttaaaaagtgcaggaataatttactcatttaagttgtttatgttagcatcacctttagatgaataaataatttgatctgtaatcaaaaatcaagagtttataaaatattttagagatgacttttaggtggagttacaaggtgagctgtaagtaatgagagagagacagagcagatagggcccaggtctctggatcagaacaacactgtttatattggagctgtgcatagtaattgattttaaggtttctcctacttaaaacaatttttttttcttgaacttcagtgaaaaaagtcttgtgctagagccagcttctactggcccatgaaagcatattgttatattttaaggaattttacaagctggttaattgatgtcttgttagtagcttgaaattggccgtggtgggagtgtttgcacaatggatattagtaaatgcagcaaatcagtctcccgctttttttccagagagctggtttttaaaaatgtatcagcatttccctgcttaccatagggattttaaatgatactgaatattatcatttaaaatttaagaatatttaagagtggaattgaggcctttagtttgagaaaacttaattcattctgccagagtttcatatttttcatttattagatgatttaagactttatatactttaaagcaaaatttggcaaatcccttattactagtattcgtctttagaatttggccgggcacagtggctcacacctgtagtcccagcactttgggaggctgaggctggcgaattaccagaggtcagaggttcgagacctgcctagccaacgtggtgaaaccctgtctctactaaaaatacaaaaattagccgggtgtggtggcatgcgcctgtaatcccagctactcgggaggctgaagcatgagaatcgcttgaacctggtaagtagaggttggagtgagtcaagatcgtgccactgcactccagcctgtgcaacaagagcgaaactctatctcaaaaaaaaaaaaaaagaatttactctcattaaaaccaaacaaatgtaaacccaaccaatactttttaaaaataatatttcatagacatcttgtggtctgagtgataacattgaatatttccagttagagggctatgggttggttatctagcgtggtattaatgaatttaaagttatagatactatgttagtgttgaacaagaaaaaattttctagcttttaacctgagccaatcacgtcaaaaatgatttgttagataccaaagtacttgttcctactattatttttgtatatgaagaactggctttggatttaactgaaaacttaggaaaacaatctaatcgctgttgtctatatcattgatttaattcatcaaagttactcaaatgattgatatttttacttgctaattattttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaa

SEQ ID NO: 13459 - DNA, 2147 bp, Homo sapiens
ccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttataatcaatttattaataaaatgatggaaagtgggtaaggcaaacaggcaaatttagggactgtgaatgaaatattgtagtatatggcattttgaattggtaaagtaattccaaaaattaaataagaatacacattgttcagttgctaagaaaaatgcattctaacagtacaaatgaagtccagagtcagatcttttctcaaaatacttggcatatcaacacattacacataaacaaataaaaaccagtcctgtccctcatgataatgggtttctaatgtgatgtattcttgcaatctgaaacaccttataaagctgtattttcctgattgatgttggaaaaagcattcccaaaatgtgaattattgtttttatgaatagttacagaggatgtgatgacaatatgccagataatctatgtaattctttattcctggatacaagcacatggtggactgttttctcacaaccgattaaaattggatttatttttgcatgagaattgtaagggagccacaaccatgagtagtaacataattaatatacagtgtcaatattttatatttaatgagacatttattctataatcagttcttatttataaagaggcgcaaatcaatttcaacctgtaattacctctgtgctttgtgactcaggcacaatctaaacccagcttaatgaatcaaagagatgtttcttggcaagatattttcattaaagttatttggaaagggcaattaactgcaaaagggacttttttttttttaactgacaagatactatctaaactaatagtttaaaataacattgcttttatgtcaaagcactttggtaacttggcctcacatgctgacagttttggctaaatattacaaatcttgatcccagaagagcaagagagaaagttttactaatatttgcttaaacatcctgtttaacaactttataacatccttcggaatttttaaggtaataatgtgagatataagtatgataaaaacaacttttaaatggtatttaatgcaa

SEQ ID NO: 13460 - DNA, 1916 bp, Homo sapiens
gaggtggaggttgcaggtagctgtgattgtgccaccacactcctgcctgggcaagagagtgagactctcaaaaagaaaacataatagtatcatctaacacatattgtggttagtatattaaaagcactattctaagtgcttacccacattaactcttaatcttcacaaccatcccattggaatattatccatgttatatagaatgtatctgcttataaaactttacaattagattcattatttaagagaaagaagcaaagtcacaatttcactcttgaaaacagtagtaattgtcctagaaacaaacagccctttaccaaatagtttacagtggtcataggcagtaatattttgctgattttgtcctttaccctctggctctgaactcattttatcttattctatggtgagttttcagttgaattccgaccactctcttaccttctgcctgcagaaggacatcacagaacacatcactctgctgctggtgatgaagctgcagaaaagctaacctgaggaaccgggggttcctgtataggattttgggactggcaggagagcacatgttggcaagagtcttaacaaaccttctaggttttcacagatcagactcctgtaggtgagataatacatttcagaggcatggttacatctaatttgttttttgtctttgaaatggcaggggaattttgaaagtgagagataatagtatgagttgaggaaacatcagcccagaaattgtgccaaggatatctcaagaaagaaaattatcatagtggttacatgtgggagctcagagataagcctaggtttgggtcttggctctatttattagcctggctgtataatctcacacaggtgacctaacttctctgagtctcactttcctatccatgaaatagaataatagtacttaccttgtagggttgttttaaagattaaatgagtcagtgaaggtaaagttgcttagcacagtgagtgcctggcacaaaataactaccaagccccaaatggtaactattattatccttcaaccttcctcatttccattaccactgagactcaactgctacaatgctgactacttatattcttcctgagcaccacatcccagctccacaggtataatcttcaagttaacacttttaaggaaacattactgggtataaaattatctctagtaagtcgtatgcgccttttctctgagctcactgtatcacactaaccagcagagggtgcacaataaagaagagaagcctctgactctgcgggaaggtctctcacagaaccaaggacgttgccacccttggctgggtgtacttgaccaaagcgagcctgactgaccctggtagtaggcaaagaatttggcctttacgtttgtatagttaattaccaggctaacaatgcagcaaggatagtaaagcattttacccctcccaaaacaaactgagtattctgacttcaggcttatgtccagctttttagctccgaaacccccccactcactgcacagctgtgttcctttcctggaatgcagttttctatcaggtagcactgagggtccgaacagttcacgtcaaaactatcaggaaagaagaatgaaaaggtaaattaagagaaggcgggcttggctgggcggggtggctcacgcctgtaatcccagcactttgggaggccgaggcgggtggatcacctgaggttaggagtttgagaccagcctggccaacatggtgactccccgtctctacaaaaatacgaaaattagccgggcatggtggcaggcgcctgtaatctcagctactcaggaggctgaggtgggagaatcgcttgaacctgggaggcagaggttgtagatagagccactgcactccagcctgggcgacagagcgagactccgtctcaaaaaaaaaaaaaaa

SEQ ID NO: 13461 - DNA, 3044 bp, Homo sapiens
gtaatcccagcactttgagaggccaaggcaggtggatcacctgaggtcaggagttcaagaccagcctggccaacatggtgaaacccggtctctactaaaaaatacaaaaattagccaggtgtggtggcatatccctgtaatcccagctactcaggagactgagggaggagaatcgcttgaacccagaaggcggagacagcagtgagctgagaccgcgcaattgcacttcagcctgggcgacagcgcaagaatctcaaaaaaaaaaaaaaaaaaaaaaaaaaaatcaaatgagacactatactgtatgtaatccacaaactgtagagtggtatacaatattggttatcataattattttttataaatgaagacattgagccccagagagatgaagttacctgcccatttcttgggcctttatatatcaggatctacttagtaactctgactcctaatcttgggccttgtacattatatatcagggtctactttatgctgaattaacatttccagtgtgaagtgaaggggtggaaataacctatacatttttagttctagcaacaaacaacaaaagtcatcaatttgaagattaaataaattaagcaggccgggcaacgtggctcacgcctgtaatcccagcactttgggaggctgaggcaggtgaatcatgaggtcaggagttcgagaccagtctggccaacatagtgaaaccccatctctactaaaaatacaaaaaattttccgggtgtggtggcacgcacctgtagtcccagctactcgggaggctgaggcggcagaatcgcttgaacgcgggaggtggaggttgcagtgagctgagaccgtgccattgcactccagcctgggagacagagagagactctgtctcaaaaacaaaacaacaacaaaaaagaaaatgggaaaagggtcggacgtggtggctcacgcctataatcccagcactttggcaagcccaggcgggtggatcacttgaggccaggagtttgagaccagcctggccatcatggcaaaacctcatctctactaaaaatacaaaagttagctgggcgtagtggcgcatgcctgtaatctcagctacttgagaaagctaaggcatgagaatcacttgaacccaggaggtggaggttgcaggtagctgtgattgtgccaccacactcctgcctgggcaagagagtgagactctcaaaaagaaaacataatagtatcatctaacacatattgtggttagtatattaaaagcactattctaagtgcttacccacattaactcttaatcttcacaaccatcccattggaatattatccatgttatatagaatgtatctgcttataaaactttacaattagattcattatttaagagaaagaagcaaagtcacaatttcactcttgaaaacagtagtaattgtcctagaaacaaacagccctttaccaaatagtttacagtggtcataggcagtaatattttgctgattttgtcctttaccctctggctctgaactcattttatcttattctatggtgagttttcagttgaattccgaccactctcttaccttctgcctgcagaaggacatcacagaacacatcactctgctgctggtgatgaagctgcagaaaagctaacctgaggaaccgggggttcctgtataggattttgggactggcaggagagcacatgttggcaagagtcttaacaaaccttctaggttttcacagatcagactcctgtaggtgagataatacatttcagaggcatggttacatctaatttgttttttgtctttgaaatggcaggggaattttgaaagtgagagataatagtatgagttgaggaaacatcagcccagaaattgtgccaaggatatctcaagaaagaaaattatcatagtggttacatgtgggagctcagagataagcctaggtttgggtcttggctctatttattagcctggctgtataatctcacacaggtgacctaacttctctgagtctcactttcctatccatgaaatagaataatagtacttaccttgtagggttgttttaaagattaaatgagtcagtgaaggtaaagttgcttagcacagtgagtgcctggcacaaaataactaccaagccccaaatggtaactattattatccttcaaccttcctcatttccattaccactgagactcaactgctacaatgctgactacttatattcttcctgagcaccacatcccagctccacaggtataatcttcaagttaacacttttaaggaaacattactgggtataaaattatctctagtaagtcgtatgcgccttttctctgagctcactgtatcacactaaccagcagagggtgcacaataaagaagagaagcctctgactctgcgggaaggtctctcacagaaccaaggacgttgccacccttggctgggtgtacttgaccaaagcgagcctgactgaccctggtagtaggcaaagaatttggcctttacgtttgtatagttaattaccaggctaacaatgcagcaaggatagtaaagcattttacccctcccaaaacaaactgagtattctgacttcaggcttatgtccagctttttagctccgaaacccccccactcactgcacagctgtgttcctttcctggaatgcagttttctatcaggtagcactgagggtccgaacagttcacgtcaaaactatcaggaaagaagaatgaaaaggtaaattaagagaaggcgggcttggctgggcggggtggctcacgcctgtaatcccagcactttgggaggccgaggcgggtggatcacctgaggttaggagtttgagaccagcctggccaacatggtgactccccgtctctacaaaaatacgaaaattagccgggcatggtggcaggcgcctgtaatctcagctactcaggaggctgaggtgggagaatcgcttgaacctgggaggcagaggttgtagatagagccactgcactccagcctgggcgacagagcgagactccgtctcaaaaaaaaaa

SEQ ID NO: 13462 - DNA, 1917 bp, Homo sapiens
gaggtggaggttgcaggtagctgtgattgtgccaccacactcctgcctgggcaagagagtgagactctcaaaaagaaaacataatagtatcatctaacacatattgtggttagtatattaaaagcactattctaagtgcttacccacattaactcttaatcttcacaaccatcccattggaatattatccatgttatatagaatgtatctgcttataaaactttacaattagattcattatttaagagaaagaagcaaagtcacaatttcactcttgaaaacagtagtaattgtcctagaaacaaacagccctttaccaaatagtttacagtggtcataggcagtaatattttgctgattttgtcctttaccctctggctctgaactcattttatcttattctatggtgagttttcagttgaattccgaccactctcttaccttctgcctgcagaaggacatcacagaacacatcactctgctgctggtgatgaagctgcagaaaagctaacctgaggaaccgggggttcctgtataggattttgggactggcaggagagcacatgttggcaagagtcttaacaaaccttctaggttttcacagatcagactcctgtaggtgagataatacatttcagaggcatggttacatctaatttgttttttgtctttgaaatggcaggggaattttgaaagtgagagataatagtatgagttgaggaaacatcagcccagaaattgtgccaaggatatctcaagaaagaaaattatcatagtggttacatgtgggagctcagagataagcctaggtttgggtcttggctctatttattagcctggctgtataatctcacacaggtgacctaacttctctgagtctcactttcctatccatgaaatagaataatagtacttaccttgtagggttgttttaaagattaaatgagtcagtgaaggtaaagttgcttagcacagtgagtgcctggcacaaaataactaccaagccccaaatggtaactattattatccttcaaccttcctcatttccattaccactgagactcaactgctacaatgctgactacttatattcttcctgagcaccacatcccagctccacaggtataatcttcaagttaacacttttaaggaaacattactgggtataaaattatctctagtaagtcgtatgcgccttttctctgagctcactgtatcacactaaccagcagagggtgcacaataaagaagagaagcctctgactctgcgggaaggtctctcacagaaccaaggacgttgccacccttggctgggtgtacttgaccaaagcgagcctgactgaccctggtagtaggcaaagaatttggcctttacgtttgtatagttaattaccaggctaacaatgcagcaaggatagtaaagcattttacccctcccaaaacaaactgagtattctgacttcaggcttatgtccagctttttagctccgaaacccccccactcactgcacagctgtgttcctttcctggaatgcagttttctatcaggtagcactgagggtccgaacagttcacgtcaaaactatcaggaaagaagaatgaaaaggtaaattaagagaaggcgggcttggctgggcggggtggctcacgcctgtaatcccagcactttgggaggccgaggcgggtggatcacctgaggttaggagtttgagaccagcctggccaacatggtgactccccgtctctacaaaaatacgaaaattagccgggcatggtggcaggcgcctgtaatctcagctactcaggaggctgaggtgggagaatcgcttgaacctgggaggcagaggttgtagatagagccactgcactccagcctgggcgacagagcgagactccgtctcaaaaaaaaaaaaaaaa

SEQ ID NO: 13463 - DNA, 312 bp, Homo sapiens
ctgtatacgtgctgctgtctgccaggaaaaatccctgcttcctcccacttgtttgtctttcagatctcacctaaggggttattccaagaaaagttccctaacccttgtctcccagtctcctcaagtctgtgaaggatgtttcttttttatcctcctaagtctgcctatgacttacccaattatatttttaatatattgcacagttacttgaatgcactggatttttgaatgtcttccccttataagatttccttaagaagaggaacttttgtatgaccacggtagcagtgtttagcatacaacaggcaactg

SEQ ID NO: 13464 - DNA, 761 bp, Homo sapiens
aaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgtgatccatgtcactgtgtggtgaggtttattcacagtcagtctggtctgtaaaatagaacctgcagacagtgaacctgaaaagcatactaggatcatccaggcctccctccccagccttggagctgggaccctcaaagcagggacatagaaggacttggagtgagccacccacaaactccagggtgaaggagagtgtgagttcagaaaagcccccttttggctggttgtggtggctcatgcctggaaacccagcactttgggaagccaaggcaagcagatcacttgaggtcaggacttcgagaccagcctggccaacatggtgaaaccctgtctctactaaaaatacaaaacttagctgggcatggtggcacatgcctgtaatcccagttactcgggaagctgaggtgggagaatcttttggaccccggaggcggagattgcagtgagccgagatcgtgccactgtactctagcctgggcgacagagcaagactccatctcaaaaaaaaaaaaaaaaaagaa

SEQ ID NO: 13465 - DNA, 534 bp, Homo sapiens
catggagataggatgtgagccagagaaggcattaaaatttttccaatagaaaaatactaaagagtaaaaaggtaaagagaggccaggcacggtggctcatgcctgtagtcccagcactttgggaggccaaagtcagaggatcgcttgagcccaggagtttgaggccagccctggcaacatagggagacctcatctctacaaaaaaaaattttattttattttatttattttatttcattttatttatttattattatttttttttgagatggagtcttgctctgttgcccaggctggagtgcagtggtgcagtctcggctcactgcaagctctgcctcccgggttcacgccattctcctgcctcagcctcctgagtagctgggactacaggcgcccgccaccacgcccggctaatggtttttttgtatttttagtagagaccaggtttcaccgtgttagccaggatggtcttgatctcctgacctcgtgatccacccgccttggcctcccaaagcactgggattacaggcatga

SEQ ID NO: 13466 - DNA, 2626 bp, Homo sapiens
aagcttcatctgcccaccaagttttaaattgtaagaactgagcaggagttagacaagctcgagtaagagcatcccagtcagtaggaatcatccaactggaaacagcaacattctttaacagtcccattacaaaaggagaacctggtccatactgattaacagcttgtttaaattctttaaataatttaaaaggaaaaggctcaaatgtaactataatatttccctgttgatctggggggtgtattctaacagggaattgccaagcctctaaatcgccctctcatctagcttgctgaattcctgcctgaatagaactaagagcagttgctcaaggcattgctcagtcactggggcaactacttttcacccaatgtcctctggaaaagaaagatctggagggtctttttcttcaaaataataaggagggggtgcagaagggtagggatgaacctctccctcctttgccgcttgagctttagctggcaaattggcaaataaacctgctctgtaacctcttctgttacttcgttttactctccttcctcctcatcatcagtgtgaaaaagttccaagggagaacgcaccagaccccacatttgtcccactgttaccctgatgcttgtgagctccccttactcaccacagggatggctttaagagtacttgggtgtcctccagcttagttccacattctccgttgctccagtgacccttcaacctggattcgagcccccacaatggacgccacttgccgagaccagttcagtcagggagaccctaacccagcagcactagaggaattaaagacatacacacagaaatatagaggtgtgaggtggaaaatcaggggtctcacagccttcagagctgagagccccaaccggagatttacccatgtatttattaacagcaagccagtcattagcattgtttctatagttattaaattaactaaaagtatcccttatgagaaatgaagggatgggccaagttaaaggaataggttgggctagttaactgcagcaggagcatgtccttaaggcacagatcgctcatgctattgtttgtggtttaagaatgcctttaagcggttttccgccctgggtgggccaggtattccttgccctcattcctgtaaacctgcaaccttccagcgtgggcgttatggccatcatgaaaatgtcacagtgctacagagattttgtttatggccagttttggggccagtttatggccagattttggggggcctgttcccaacaccaggagatgtgttgatttgctccagcaatgaaaccacatctggtacggcagctgcaattggagtcactacttagttaagctcatcataatccactgtcatcctccaagatccatctgtcttctgcacaggccaaatgggagagttgaacagggagatggtgggaatcaccacccctgtgtccttcaagtccttgatagtagcactaatctccacgttccctccagggattcaatattgtttttgatttactacttttctaggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaagagaaaagaaaagacacctgggcccaggggaccactaccaccaagacgcagagaccggtagtggtcccaaatgccaggctgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagacagcttacaccattatttctgcatatcagagacttttagtactttcactaattttctactgctatctaaaaggcagagccaggtgtacaggatggaacacgaaagcagactaggagcgtgaccactgaaacacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccgctagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 13467 - DNA, 2626 bp, Homo sapiens
aagcttcatctgcccaccaagttttaaattgtaagaactgagcaggagttagacaagctcgagtaagagcatcccagtcagtaggaatcatccaactggaaacagcaacattctttaacagtcccattacaaaaggagaacctggtccatactgattaacagcttgtttaaattctttaaataatttaaaaggaaaaggctcaaatgtaactataatatttccctgttgatctggggggtgtattctaacagggaattgccaagcctctaaatcgccctctcatctagcttgctgaattcctgcctgaatagaactaagagcagttgctcaaggcattgctcagtcactggggcaactacttttcacccaatgtcctctggaaaagaaagatctggagggtctttttcttcaaaataataaggagggggtgcagaagggtagggatgaacctctccctcctttgccgcttgagctttagctggcaaattggcaaataaacctgctctgtaacctcttctgttacttcgttttactctccttcctcctcatcatcagtgtgaaaaagttccaagggagaacgcaccagaccccacatttgtcccactgttaccctgatgcttctgagctccccttactcaccacagggatggctttaagagtacttgggtgtcctccagcttagttccacattctccgttgctccagtgacccttcaacctggattcgagcccccacaatggacgtcacttgccgagaccagttcagtcagggagaccctaacccagcagcactagaggaattaaagacatacacacagaaatatagaggtgtgaggtggaaaatcaggggtctcacagccttcagagctgagagccccaaccggagatttacccatgtatttattaacagcaagccagtcattagcattgtttctatagttattaaattaactaaaagtatcccttatgagaaatgaagggatgggccaagttaaaggaataggttgggctagttaactgcagcaggagcatgtccttaaggcacagatcgctcatgctattgtttgtggtttaagaatgcctttaagcggttttccgccctgggtgggccaggtattccttgccctcattcctgtaaacctgcaaccttccagcgtgggcgttatggccatcatgaaaatgtcacagtgctacagagattttgtttatggccagttttggggccagtttatggccagattttggggggcctgttcccaacaccaggagatgtgttgatttgctccagcaatgaaaccacatctggtacggcagctgcaattggagtcactacttagttaagctcatcataatccactgtcatcctccaagatccatctgtcttctgcacaggccaaatgggagagttgaacagggagatggtgggaatcaccacccctgtgtccttcaagtccttgatagtagcactaatctccatgttccctccagggattcaatattgtttttgatttactacttttctaggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaagagaaaagaaaagacacctgggcccaggggaccactaccaccaagacgcagagaccggtagtggtcccaaatgccaggctgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagacagcttacaccattatttctgcatatcagagacttttagtactttcactaattttctactgctatctaaaaggcagagccaggtgtacaggatggaacacgaaagcagactaggagcgtgaccactgaagcacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccactagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 13468 - DNA, 109 bp, Homo sapiens
cagtgtgggcgttatggccatcatgaacatgtcacagtgctgcagagattttgtttatggccagttttggggccagtttatggccaaattttggggggcttgttcccaa

SEQ ID NO: 13469 - DNA, 2627 bp, Homo sapiens
aagcttcatctgcccaccaagttttaaattgtaagaactgagcaggagttagacaagctcgagtaagagcatcccagtcagtaggaatcatccaactggaaacagcaacattctttaacagtcccattacaaaaggagaacctggtccatactgattaacagcttgtttaaattctttaaataatttaaaaggaaaaggctcaaatgtaactataatatttccctgttgatctggggggtgtattctaacagggaattgccaagcctctaaatcgccctctcatctagcttgctgaattcctgcctgaatagaactaagagcagttgctcaaggcattgctcagtcactggggcaactacttttcacccaatgtcctctggaaaagaaagatctggagggtctttttcttcaaaataataaggagggggtgcagaagggtagggatgaacctctccctcctttgccgcttgagctttagctggcaaattggcaaataaacctgctctgtaacctcttctgttacttcgttttactctccttcctcctcatcatcagtgtgaaaaagttccaagggagaacgcaccagaccccacatttgtcccactgttaccctgatgcttctgagctccccttactcaccacagggatggctttaagagtacttgggtgtcctccagcttagttccacattctccgttgctccagtgacccttcaacctggattcgagcccccacaatggacgtcacttgccgagaccagttcagtcagggagaccctaacccagcagcactagaggaattaaagacatacacacagaaatatagaggtgtgaggtggaaaatcaggggtctcacagccttcagagctgagagccccaaccggagatttacccatgtatttattaacagcaagccagtcattagcattgtttctatagttattaaattaactaaaagtatcccttatgagaaatgaagggatgggccaagttaaaggaataggttgggctagttaactgcagcaggagcatgtccttaaggcacagatcgctcatgctattgtttgtggtttaagaatgcctttaaccggttttccgccctgggtgggccaggtattccttgccctcattcctgtaaacctgcaaccttccagcgtgggcgttatggccatcatgaaaatgtcacagtgctacagaaattttgtttatggccagttttggggccagtttatggccagattttggggggcctgttcccaacaccaggagatgtgttgatttgctccagcaatgaaaccacatctggtacggcagctgcaattggagtcactacgtacttaagctcatcataatccactgtaatcctccaagatcaatctgtcttctgcacaggccaaatgggagagttgaacagggagatggtgggaatccccacccctgtgtccttcaagtccttgatagtaacactaatctccatgttccctccagggattcaatattgtttttgatttactacttttctaggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctcccccgtgtgcggagatgagagagcatagaaataaagacacaagacaaagagaaaagaaaagacacctgggcccaggggaccactaccaccaagacgcagagaccggtagtggtcccaaatgccagggtgcactgatatttattagatacaagacaaaggggcagggtaaggagtgtgagccatctccaatgataggtaaggccacgtgggtcatgtgtccactgaacagggggcccttccctgcctggcagccgaggcagagagagagggagagagagagaccgcttacaccattatttctgcatatcagagacttttagtactttcactaattttctactgctatctaaaaggcagagccaggtgtacaggatggaacacgaaagcagactaggagcgtgaccactgaagcacagcatcacagggagacggttaggcccctggataactgcgggcaggcctgactgatgtcaggccctccacaagaggtggaggactagagtcttctctaaactcccccagggaaagggacactccctttcccggtctgctaagtagcaggtatttttccttggcactgacgctactgctagaccacggtctacttggcaacaggcgttttcccagatgctggcgttaccactagaccaaggagccctctggtggccctgtctgggcataacagaaggctcacactcatgtcttctggtcacttctcactatgtcccctcagctcctatatctgtatggcctggtttttcctaggttatgattatagagtgaggattattataatattggaataaagagtaattgctacaaact

SEQ ID NO: 13470 - DNA, 422 bp, Homo sapiens
atagtaccaggttgtccatcaggccctacacaatgcaaaatataactactttgatatacttcaggggctttaccaattccaactatgttaaattgggtgggttgaattggccacatggacggccactgctgtacagaaatgattgaaatgtccactcctgtatctaccaaacctttaaatttctttccctgaatagttatttcacaggtaggacgtttatcagtaacttgctttacccgataagctgctttgccttgtttatttgtgcttccaaatcctcctgttcatgtaacttcactttttcccattcccacatatggcacaatcaggagctgtgctatgcactctcctggctctgctttccagggaacagaagtagatataacaatttgaatttccccattgtaatctgaatcaatgac

SEQ ID NO: 13471 - DNA, 299 bp, Homo sapiens
tttttttttttgtttttttttttttttgaggcggagtctcgctctgtcacccaggctggagtgcagtggtgcgaactcagctcactgcaagctccacctcctgggttcatgccattctcctgcctcagccttccgagtagctgggactacaggcgcctgccaccacgcctggctaattttttgtatttttagtagagatggggtttcactgtgttagccaggatggtcttgatctcctgacctcatgatcctcccacctcagcctcccaaagtgctgggattacagacgtgagccactg

SEQ ID NO: 13472 - DNA, 422 bp, Homo sapiens
atagtaccaggttgtccatcaggccctacacaatgcaaaatataactactttgatatacttcaggggctttaccaattccaactatgttaaattgggtgggttgaattggccacgtggacggccactgctgtacagaaatgattgaaatgtccactcctgtatctaccaaacctttaaatttctttccctgaatagttatttcacaggtaggacgtttatcagtaacttgctttacccgataagctgctttgccttgtttatttgtgcttccaaatcctcctgttcatgtaacttcactttttcccattcccacatatggcacaatcaggagctgtgctatgcactctcctggctctgctttccagggaacagaagtagatataacaatttgaatttccccattgtaatctgaatcaatgac

SEQ ID NO: 13473 - DNA, 260 bp, Homo sapiens
tttttttttttgtttttttttttttttgaggcggagtctcgctctgtcacccaggctggagtgcagtggtgcgaactcagctcactgcaagctccacctcctgggttcatgccattctcctgcctcagccttccgagtagctgggactacaggcgcctgccaccacgcctggctaattttttgtatttttagtagagatggggtttcactgtgttagccaggatggtcttgatctcctgacctcatgatcctcccacctc

SEQ ID NO: 13474 - DNA, 391 bp, Homo sapiens
tttctttctttcgttcgttctctctttctgccgagaccagctcggtcgggggagaccctaacccagcggtgctagaggaattaaagacacacacacagaaatatagaggtgtgaagtgagaaaccaggggtctcacagccttcagagctgagagccccgaacagagatttacccacgtatttattaacagcaagccagtcattagcattgtttctatagatattaaattaactaaaagtatcccttatgggaaacgaagggatgggctgaattaaaggaataggttgggctagttaactgcagcaggagcatgtccttaaggcacagatcactcatgctattgtttgtggcttaagaatgcctttaagcggttttccgccctgggcggggc

SEQ ID NO: 13475 - DNA, 422 bp, Homo sapiens; identical to SEQ ID NO: 13472

SEQ ID NO: 13476 - DNA, 252 bp, Homo sapiens
tctttttttttttgtttttttttttttttgaggcggagtctcgctctgtcacccaggctggagtgcagtggtgcgaactcagctcactgcaagctccacctcctgggttcatgccattctcctgcctcagccttccgagtagctgggactacaggcgcctgccaccacgcctggctaattttttgtatttttagtagagatggggtttcactgtgttagccaggatggtcttgatctcctgacctcatgatc

SEQ ID NO: 13477 - DNA, 1218 bp, Homo sapiens
ggatcacaggtgctcaccaccatgtccggcgaatttttgtattttttgtagagacgaggtttcgccatgttgcccaggctggtctcgaactcctgaccaggtgatccacctgccacggcctcccaaagtggtaggattacaggcatgagccactgcacccggctaatttttgtattttttgtagagatggggttttaccaggttggccaggctgtcccctgatctttaccttagtaagtaacagatttcttcatggatttatcaatttgtagacatcatctgctgatttcttgtcacggctgttgagatcttctccctcccatccacccactgcaccttcaccttccatatcctgaatgagtttatgtcatgagcatagttggtcattggttgtgttttctaaataagatgcaaaatattgttggctgctaaaacaagtaatatgttcagctaggcttttcttgtaccattctatcttcccttaaagctaattaactttgtttttaccatgagcctgattttcttttacctgctgtttgttttttccccacaaagctcccacctctcacacacctatcagttgtattttgcataggtttaaataaattgatctcccctcaccacttccctccaagacccccttatcctcctcctccaaatgggactggttgtgctctgacctggaagtggagctgttgtcccaaaccttcctgtccttgctcccctgtgctgacctctgtttccagtgtggtcatctctttcccttcatgctgtccgagcaaaacttctgggagcttttgaagaaacagatgatttttttcggggggtgggggaagtccttgattgtctgaaaacgagtttatttaccctcatagttagaagtttggtggggtataaaaatctagattgaaaatctgtatttgtaggccgggcgtggtggctcacgcctgtaatcccagcactttgggaggctgaggcgggcggatgacctgagtttgggagtttgagaccagcctcgccaacctggcgaaatcccatctccactaaaaatataaaaatttgccaggcgttttggcatgtgcctgtaatctcagctactcgggaggctaaggcaggagaatggcttgaacctgggaggtggaggttgcagtgagccaagatcgagctactgcctgggcgacagagcgagaatccgtctcaaaaaaaaaaaaaaaaaaa

SEQ ID NO: 13478 - DNA, 388 bp, Homo sapiens
ctcccctccctcctcccgtgagcgtccggccttgtgcatcctgaggccccgcgctgggcgggcctggagggtcgggcccgccaggaactctatttccaaactcctgttgggaggccgcgcgcggggcctcacgcctgtaatctcactgctcagggaggccttggcgggaggatcgcttgaggccaggagttcgagaccagcctggacaacacaccgagacccccatctctacaaaaaattttaaaaaattagccaggagtggtggttgtacctgtaggcccagctactcgagaggatcgcttgagctcggaatgtcgaggctgcagtgagccatgatcccaccactgcactccagcctgggcaacatagcgagaccccatcactgcaa

SEQ ID NO: 13479 - DNA, 294 bp, Homo sapiens
tcttgctaatgttcttatgttatttctgtgataatatttttcctgttttattttgttgggtgttttttcagttctcactctggaatgtcctctaggttcttgcttttcctcctgtttttttaacttttgactttcctttatgaaagatttgtttggctcagcttccaactctggtatggaattttttgtttggatcgtcctgtctgtatttttcaagggctttttgttttaattcagcttgtcattcagcttcctgttctgggtttgtggtgcagtggcttcccccgataatga

SEQ ID NO: 13480 - DNA, 574 bp, Homo sapiens
tatactttaagttttagggatctgtggggttttaagccatggttagtgatagcatgtcatttgaagatgtacccccttaatgacttacaggctcatagtgattttttcttttttgttgttgttatttagattagatttgggtaagtctccgggttggttggaaggactcaggtttatgtggagttttgtcttttagttaatgtgccagtaacagagtttgcccgtttgtgctatgggatactcatgaggtgcccccaaacccagctggctacatatacagcctcttgcttcctcttcactgtctcctgggctcttcctccagctctcctcatgccaaactcgtgactgcatggacacaacatagggaggtgattaggaccatgtattttggaggcaaactgtctgtatttgagtcctgcctaccctggttattagtgaagtggtttgagtaagttacttcaaacttctgtgcacttcagtttcttgatctggaaactgaaggtaatatacctaccttacagggatattgtgaggattaaaatagataatgtaaaatgaaaaaaaaagaaaaaaa

SEQ ID NO: 13481 - DNA, 942 bp, Homo sapiens
tggtgaacctcaactccagtatagtcacttgtttttttcatttttaaaagacgtcatcaaaagagttgtggttataaaaacagttgtaagcacattgcagaaaatttgaaaaacagagaaaaggaaacctataacctcaacatcgtaacgcatgttactgtcattgttttatttccttccagccttcttctttttttattaaaatctcttttgaaaatatgtatcagccagtatcagctggatgcctaccatgtgcctagcgttaagtcttttgggggattgttagaagcaagcaagatccttctaggtccttataatctaggttttgagatagataattattaaaattaatgagagagtattgtcaacattaaaaaacaaaaacccagactccttccagtaaggatttgaagcagttttcaataataggttagaaccaaaagatacacatattctcacacatacacattataatggtataaaggagcaataatcaagtaataggggctaggaaatgtacagtaactgacaaaaagtctgaattgctacttcttattgaaattgagtagaaaccttagctttgagcttcttagcagtagggcagaaagggaaggaaacactgagagtaacgtggggtaaatgatagctgagaaggaaggggatgctggaggcacaggaaggcatgagactgtgtacacgagtttatatgttcttacttgtatagcatgcaattctttgtttgagtgttgcttggtattcatttgttagtgttttattgtgtttggtttcctgatctagaagggaagctgcttgctgcttaattattcatatgctacccaaaacctgtatgttgctttatatatgatgaataattatgttatatataataatcattacactagaaacttatatttatagcataggcagtgagattgaatagct

SEQ ID NO: 13482 - DNA, 292 bp, Homo sapiens
taactttgctcccaacttattttttcctttcatggaagatattggggtcatcctgccactttcattcatacaaaagaactttaactactttgcaacttggttaaacacatacacacaaaatacatattataatttatttgtaatatctgcaaatacttatcagtatttcatttgcttggttctattagagccatcatccttatcccacccaagtaattcaaggcaaaatctccaggccactttttgaattcagcccatattcactacaattgctaagtcttctcctctgtgg

SEQ ID NO: 13483 - DNA, 1288 bp, Homo sapiens
cagaaaccagttctttcaaaacattttacctctgatgtcacccagcttcctgaggctgctccccctttttgcagtttcagcacaacaactgaccagcattccttcctgataagagaccaccaaccacagagtagttctgaccagtctacagaggatgagtagtgtggattttcatgtcctctcttcaccttttgacatcagagggctgaaaactccacccttggatcatgctaacactgccattttttgtgcctgggttccatagagagtcacgaagctctgtgcatgtgcttgtttctcctttcataaatactcatgactcctcctctagcttatttttatttttatttttgagacagagtcttgctctgacgcccaggctggagcgcagtggagcaatcttggctcactgcaaactccgtctcctgggttcaagtgattcttctgcctcagcctcccaagtagctgggattataggtgcccaccaccatgcctggctaatttttataattttagtagagatggggtttcaccatgttggccaggctggtcatctcaaactcctgacctcaggtgatccacccgccttggcctcccaaagtgttgggattagaggcatgagccactgcatccgggcctcctctagcttattgaatatgtatatttggccaccctgttcatcataaattcttgttccccttgcccttcccatgaagtgtgtttctggcttctggctgggggatacactttcccagactgttagaaaggccaccctgcaggctgcaagcctttatatgtataaaaaaagctctctttttcaaatttatgaaactcatgattcttcagttgacagactggatgagaaggaactctccaggtaaggcatatgggattttgaagcttccagatccaggggaaggaacatgccttgaagctagaaaaaccttgctttgtttaagatatagaaagtagggctggaacagagtgaaggagggaaagactttctaggacaaagttagagaggtaagctgaagccaaataatccaggtcagtgtcaatccttgatgatgggataaatacagaaattgaaaataagcttgtaaagccttttaaatgatttgacatagtggtttgatagctcttcaatctaatgaaaaaattggacttatattttgatgtcttatttctggtttcattttttctagtaattcatttttattttatcttataaaagtatccatcagagaggaattgaaaattgaaaagaaaaaaaaaaaaagaaaaacaa

SEQ ID NO: 13484 - DNA, 1297 bp, Homo sapiens
cagaaaccagttctttcaaaacattttacctctgatgtcacccagcttcctgaggctgctccccctttttgcagtttcagcacaacaactgaccagcattccttcctgataagagaccaccaaccacagagtagttctgaccagtctacagaggatgagtagtgtggattttcatgtcctctcttcaccttttgacatcagagggctgaaaactccacccttggatcatgctaacactgccattttttgtgcctgggttccatagagagtcacgaagctctgtgcatgtgcttgtttctcctttcataaatactcatgactcctcctctagcttatttttatttttatttttgagacagagtcttgctctgacgcccaggctggagcgcagtggagcaatcttggctcactgcaaactccgtctcctgggttcaagtgattcttctgcctcagcctcccaagtagctgggattataggtgcccaccaccatgcctggctaatttttatatttatagtagagatggggtttcaccatgtgggccaggctggtcatctcaaactcctgacctcaggtgatccacccgccttggcctcccaaagtgttgggattagaggcgtgagccactgcatccgggcctcctctagcttattgaatatgtatatttggccaccctgttcatcataaattcttgttccccttgcccttcccatgaagtgtgtttctggcttctggctgggggatacactttcccagactgttagaaaggccaccctgcaggctgcaagcctttatatgtataaaaaaagctctctttttcaaatttatgaaactcatgattcttcagttgacagactggatgagaaggaactctccaggtaaggcatatgggattttgaagcttccagatccaggggaaggaacatgccttgaagctagaaaaaccttgctttgtttaagatatagaaagtagggctggaacagagtgaaggagggaaagactttctaggacaaagttagagaggtaagctgaagccaaataatccaggtcagtgtcaatccttgaactagcttatgatgggataaatacagaaattgaaaataagcttgtaaagccttttaaatgatttgacatagtggtttgatagctcttcaatctaatgaaaaaattggacttatattttgatgtcttatttctggtttcattttttctagtaattcatttttattttatcttataaaagtatccatcagagaggaattgaaaattgaaaagaaaaaaaaaaaaagaaaaacaa

SEQ ID NO: 13485 - DNA, 313 bp, Homo sapiens
cttaaagtgtttacccctgtgggtaatggtatcatctgaagggaatataagtgccacatgcttacactaagtgagtaaaagagtatctgtgaagttattcaaaaggatagaagagatgaaattttttttttttttttggcacacaaaccccatgaaggtcagttaatagcagacagttgtgtcattaaataattttggatttagtactattttttagaaaattcctgatttaaattgagaaaaaagaaatagcccagagcagtctgagctatgtgaggtgtgcaacatttataaggcctggagattcatgaat

SEQ ID NO: 13486 - DNA, 313 bp, Homo sapiens; identical to SEQ ID NO: 13485

SEQ ID NO: 13487 - DNA, 38771 bp, Homo sapiens; identical to SEQ ID NO: 6652
  misc_feature (7892)..(9416): n equals a,t,g, or c

SEQ ID NO: 13488 - DNA, 295 bp, Homo sapiens; identical to SEQ ID NO: 11058

SEQ ID NO: 13489 - DNA, 274 bp, Homo sapiens
caggcacggtggctcacgcctgtaatcccatcactttgggacgccgaggtgggcggatcatgaggtcaggagatcgagaccatcctggctaacacggtgaaaccccatctctactaaaaatacaaaaaatgagccgtgcgtggtggtgggcgcctgtagtcccaggtactcaggaggctgaggcaggagaatggtgtgaacccgagaggcggagcttgcagtgagccgagattgcgccactgcactccagcctgggcaacagagcgagactccg

SEQ ID NO: 13490 - DNA, 200 bp, Homo sapiens; identical to SEQ ID NO: 11059

SEQ ID NO: 13491 - DNA, 295 bp, Homo sapiens; identical to SEQ ID NO: 7552

SEQ ID NO: 13492 - DNA, 270 bp, Homo sapiens
cccagcactttgggaggacgaggcgggcagatcatgaggtcaggagatcgagaccatcctggctaacacggtgaaaccccatctctactaaaagtacaaaaaattagccaggcgtggtggggggtgcctgtagtcccagctacttgggaggctgaggcaggagaatggtgtgaacccggggaggcagagcttgcagtgagcccggatggcaccactgcactccagcctgggtgacagagcaagactccgtctcaaaaaaagaaaaaagaa

SEQ ID NO: 13493 - DNA, 116 bp, Homo sapiens
  misc_feature (76)..(76): n equals a,t,g, or c
cagcactttggaaggccgaggagggcagatcacaaggtcaggagatcgagaccatcctggctaacacggtgaaacnccgtccctactaaaaatacaaaacattagcccgcgtggtg

SEQ ID NO: 13494 - DNA, 279 bp, Homo sapiens
cctgtaatcccagtactttgggaggctgaggtgggtggatcacgagatcaggagatcgagaccatcctggataaaacggtgaaaccccgtctctactaaaaatacaaaaaattagctgggcgtggtggtgggcgcccgtagtcccagctactcaggggggctgaggcaggagaatggcgtgaacccaggaggcggagcttgcagtgagccgagatagcgccactacactccagcctgggcgaaagagagagactccgtctcaaaaaaaaaaaaagaaga

SEQ ID NO: 13495 - DNA, 316 bp, Homo sapiens; identical to SEQ ID NO: 6716

SEQ ID NO: 13496 - DNA, 305 bp, Homo sapiens; identical to SEQ ID NO: 7558

SEQ ID NO: 13497 - DNA, 300 bp, Homo sapiens; identical to SEQ ID NO: 9955

SEQ ID NO: 13498 - DNA, 284 bp, Homo sapiens; identical to SEQ ID NO: 7559

SEQ ID NO: 13499 - DNA, 150 bp, Homo sapiens
aagacctggcacggtggctcacgcctgtaatcccagcactttgggaggccgaggtgagcagattacgaggtcaggagatggagaccatcctggcaagcacggtgaaaccccatctctactaaaaatacaaaaaattagccgggcgtggtg

SEQ ID NO: 13500 - DNA, 283 bp, Homo sapiens; identical to SEQ ID NO: 7561

SEQ ID NO: 13501 - DNA, 1052 bp, Homo sapiens; identical to SEQ ID NO: 6718

SEQ ID NO: 13502 - DNA, 203 bp, Homo sapiens; identical to SEQ ID NO: 11072

SEQ ID NO: 13503 - DNA, 293 bp, Homo sapiens; identical to SEQ ID NO: 6719

SEQ ID NO: 13504 - DNA, 295 bp, Homo sapiens; identical to SEQ ID NO: 7564

SEQ ID NO: 13505 - DNA, 263 bp, Homo sapiens; identical to SEQ ID NO: 7567

SEQ ID NO: 13506 - DNA, 294 bp, Homo sapiens; identical to SEQ ID NO: 7571

SEQ ID NO: 13507 - DNA, 149 bp, Homo sapiens; identical to SEQ ID NO: 6722

SEQ ID NO: 13508 - DNA, 305 bp, Homo sapiens; identical to SEQ ID NO: 7573

SEQ ID NO: 13509 - DNA, 316 bp, Homo sapiens; identical to SEQ ID NO: 7580

SEQ ID NO: 13510 - DNA, 130 bp, Homo sapiens; identical to SEQ ID NO: 11086

SEQ ID NO: 13511 - DNA, 246 bp, Homo sapiens
gaggctgaggcaggcggatcacgaggtcaggagatcgagaccatcctgggtaacacggtgaaaccccgtctctactaaaaatacaaaaaaattagccaggcatggtgcggcgcctgtagtcctagctacttgggaggctgaggcaggagaatggcatgaacccgggaagcggagcttgcagtgagccaagatcgcgccactgcactccagcctgggcgacagagcaagactccatcaaaaaaaaaa

SEQ ID NO: 13512 - DNA, 257 bp, Homo sapiens; identical to SEQ ID NO: 9968

SEQ ID NO: 13513 - DNA, 298 bp, Homo sapiens; identical to SEQ ID NO: 7593

SEQ ID NO: 13514 - DNA, 140 bp, Homo sapiens; identical to SEQ ID NO: 6724

SEQ ID NO: 13515 - DNA, 306 bp, Homo sapiens; identical to SEQ ID NO: 7596

SEQ ID NO: 13516 - DNA, 143 bp, Homo sapiens; identical to SEQ ID NO: 11094

SEQ ID NO: 13517 - DNA, 170 bp, Homo sapiens
cacacctgtaatcccagcactttgggaggctgaggtgggcagatcacgaggtcaggagattgagaccatcttggctaacatggtgaaaccccgtctctactaaaactacaaaaaattagccaggcatggtggtgggtacctatagtcccagctactcaggaggctgaggc

SEQ ID NO: 13518 - DNA, 279 bp, Homo sapiens; identical to SEQ ID NO: 11096

SEQ ID NO: 13519 - DNA, 95 bp, Homo sapiens
ttgggaggctgaggtgggcagatcatgaggtcaggagatcgagaccatcctggctaacacggtgaaaccccgtctctacaaaaaatacgaaaaat

SEQ ID NO: 13520 - DNA, 271 bp, Homo sapiens; identical to SEQ ID NO: 7599

SEQ ID NO: 13521 - DNA, 296 bp, Homo sapiens; identical to SEQ ID NO: 7601

SEQ ID NO: 13522 - DNA, 285 bp, Homo sapiens
acacctgtaatcccagcactttgggaggccaaggtgggcagatcacaaggtcaggggatcgacaccatcctggctaacatggtgaaaccccgtctctactaaaaatacaaaaaattagctgggcgtggtggcgggcacctgtagtctcagctactcaggaggctgaggcaggagaatggtgtgaatccaggaggcggagcttgcagtgagccaagatagcgccactgcactccagcctgggcgaaagagcgagactccatctcaaaaaaaaaaaaaaaaaaaaaa

SEQ ID NO: 13523 - DNA, 230 bp, Homo sapiens
gtggctcacgcctgtaatccagcattttgggaggccgaggcgggcggatcacgaggtcaggagatcaagaccatcctggctaacacggtgaaactccgtctttactaaaaatacaaaaaattagccaggtgtggtggcgagcacctgtagtcccagctactccgaaggctgaggcaggagaatggcgtgaacccgggaggcggagcttgcagtgagccgagatcgcacca

SEQ ID NO: 13524 - DNA, 100 bp, Homo sapiens; identical to SEQ ID NO: 11102

SEQ ID NO: 13525 - DNA, 281 bp, Homo sapiens; identical to SEQ ID NO: 6726

SEQ ID NO: 13526 - DNA, 226 bp, Homo sapiens
cacgcctataatcccagcactttgggaggctgaggcgggcggatcacgaggtcaggagctcgagaccatcctggctaacacggtgaaaccctgtctctactaaaaaatacaaaaaattagccgggcgtggtggcgggcgcctgtagtcccacctacttgggaggctgaggcaggagaatggcatgaacccgggaggtggagcgtgcagtgagctgagatcgcgcca

SEQ ID NO: 13527 - DNA, 300 bp, Homo sapiens; identical to SEQ ID NO: 6727

SEQ ID NO: 13528 - DNA, 165 bp, Homo sapiens
taatcccagcactttgggaggttgaggtgggcggatcacaaggtcaggagatcgagaccatcctggctaacacggtgaaaccccgtctctactaaaattacaaaaaattacccgggcatggtggcgggcacctgtagtcccagctactccggaggttgaggcagg

SEQ ID NO: 13529 - DNA, 140 bp, Homo sapiens; identical to SEQ ID NO: 11109

SEQ ID NO: 13530 - DNA, 252 bp, Homo sapiens
ttgggaggccaaggagggcagatcatgaggtcaggagatcgagaccagcctggctaacacggtgaaaccccgtctctactaaaaatacaaaaaattagccaggtgcggtggcggacgcctgtagtcccagctactcgggaggctgaggcaggagaatggcatgaacccaggaggcagagcttgagtgagccgagatcgcgccactgcactccagcctgggctacagagcgagactctgtctcaaaaaaaaaa

SEQ ID NO: 13531 - DNA, 301 bp, Homo sapiens; identical to SEQ ID NO: 7619

SEQ ID NO: 13532 - DNA, 2548 bp, Homo sapiens; identical to SEQ ID NO: 7621

SEQ ID NO: 13533 - DNA, 6141 bp, Homo sapiens; identical to SEQ ID NO: 7622

SEQ ID NO: 13534 - DNA, 205 bp, Homo sapiens; identical to SEQ ID NO: 6728

SEQ ID NO: 13535 - DNA, 299 bp, Homo sapiens; identical to SEQ ID NO: 11118

SEQ ID NO: 13536 - DNA, 288 bp, Homo sapiens; identical to SEQ ID NO: 7627

SEQ ID NO: 13537 - DNA, 282 bp, Homo sapiens; identical to SEQ ID NO: 7628

SEQ ID NO: 13538 - DNA, 275 bp, Homo sapiens; identical to SEQ ID NO: 7629

SEQ ID NO: 13539 - DNA, 133 bp, Homo sapiens; identical to SEQ ID NO: 11122

SEQ ID NO: 13540 - DNA, 139 bp, Homo sapiens
  misc_feature (80)..(80): n equals a,t,g, or c
tggctcacgcctgtaatcccagcactttgggaggccaaggtgggcggttcgcaaggtcaggagatcgagaccatcctggntaacacggtgaaaccccgtctctactaaaaatacaaaaaaattagccggatgtggtggc

SEQ ID NO: 13541 - DNA, 292 bp, Homo sapiens
ggctacgcacggtggctcacgcctgtaatcccagcactttgggaggccgaggtgggtggatcacgaggtcgggagatcgagaccatcctggctaacacggtgaaaccccgtctctactaaaaaatacaaaaaattagccgggcgtggtggcgggctccggtagtcccagctacacgggaggctgaggcaggagaatggcctgaacccggaaggcggagcttgcagtgagctgagatcgtgccactgaactccagcctgggagacagagtgagactccgtctcaaaaaaataa

SEQ ID NO: 13542 - DNA, 254 bp, Homo sapiens
cagcactttgggaggccgaggcgggcagatcacgaggtcaggaggtcgagaccatcctggctaacacagtgaaaccccgtctctgctaaaaatacaaaaaattagccgggcgtggtggcgggcgcccgtagtcccagctactcgggaggctgaggcaggagaatggcatgaacccgggaggcggaggttgcagatcgcgccactgcactccagcctgggcgacagagcgagactccgtctcaaaaaaaaaaaaa

SEQ ID NO: 13543 - DNA, 97 bp, Homo sapiens
cactttgggaggctaaggcaggcagatctcgaggtcaggagatcgagaccatcctggctaacgcggtgaaaccccgtctctactaaaaatacaaaaa

SEQ ID NO: 13544 - DNA, 183 bp, Homo sapiens
ctgggcgcggtggctcacgcctgtaatcctagcactttgggaggctgaggcaggcagatcatgaggtcaggagatcgagaccatcctggctaacatggtgaaaccccgtctctactaaaaatacaaaaaaattagccaggtgtggtggtgggcacctgtagtcccagctactcgggaggctga

SEQ ID NO: 13545 - DNA, 301 bp, Homo sapiens; identical to SEQ ID NO: 7637
  misc_feature (98)..(98): n equals a,t,g, or c

SEQ ID NO: 13546 - DNA, 301 bp, Homo sapiens; identical to SEQ ID NO: 7639

SEQ ID NO: 13547 - DNA, 182 bp, Homo sapiens; identical to SEQ ID NO: 8672

SEQ ID NO: 13548 - DNA, 300 bp, Homo sapiens; identical to SEQ ID NO: 6730

SEQ ID NO: 13549 - DNA, 611 bp, Homo sapiens; identical to SEQ ID NO: 7640

SEQ ID NO: 13550 - DNA, 110 bp, Homo sapiens
tgtaatcctagcactttgggagggcaaggcgggcagatcacgaggtcagaagatcgagaccatcctggctaacacggtgaatctccgtctctactaaaaatacaaaaaaa

SEQ ID NO: 13551 - DNA, 291 bp, Homo sapiens; identical to SEQ ID NO: 7641

SEQ ID NO: 13552 - DNA, 192 bp, Homo sapiens
ggggctggcgcggtgactcacgcctgtaatcccagcactttgggaggctgaggtgggcggatcacgaggtcaggagattgagaccatcctggctaacaaggtgaaaccccatctctactaaaaatacaaaaaattagccaggcgtggtggcgggtgcctgtagtcccagctactcgggagggtgaggcagaa

SEQ ID NO: 13553 - DNA, 197 bp, Homo sapiens; identical to SEQ ID NO: 11132

SEQ ID NO: 13554 - DNA, 257 bp, Homo sapiens
cagcactttgggaggtcgaggcgggcagatcacgaggtcaggagatcaagaccatcctgcctaacacggtgaaaccccgtctctactaaaaatacaaaaaattagccgggcgtggtggcaggcgcgctgtagtcccagctactctggaggctgaggcaggagaatggcgtgaacccgggaagcagagcttgcagtgagccgagatcatgccactgcactccagcctgggtgacagagcgagactccatctcaaaaaa

SEQ ID NO: 13555 - DNA, 135 bp, Homo sapiens
aggctgggcgcggtggctaacgcctgtaatcccagcactttgggaggctgaggcgggcagatcacgaggtccggagatcgagacgatcctggctaacacggtgaaaccccgtctctactaaaaataaaaaaaaaa

SEQ ID NO: 13556 - DNA, 297 bp, Homo sapiens; identical to SEQ ID NO: 7649

SEQ ID NO: 13557 - DNA, 292 bp, Homo sapiens; identical to SEQ ID NO: 7652

SEQ ID NO: 13558 - DNA, 134 bp, Homo sapiens
ggctcacccccgtaatcccagcactttgggaggctgaggcgggcagatcaccaggtcaggagattgagaccatcctggctaacacggtgaaaccccgtctctactaaaaatacaaaaaattagctgggcgtggt

SEQ ID NO: 13559 - DNA, 263 bp, Homo sapiens; identical to SEQ ID NO: 7655

SEQ ID NO: 13560 - DNA, 280 bp, Homo sapiens; identical to SEQ ID NO: 7656

SEQ ID NO: 13561 - DNA, 125 bp, Homo sapiens
cacgcctgtaatcccagcactttgggaggctgaggagggtggatcacgaggtcgggagatcgagaccatcctgactaacacagtgaaaccccatctctactaaaaatacaaaaaaaaaaaaaaaa

SEQ ID NO: 13562 - DNA, 202 bp, Homo sapiens
cccagcactttgggaggctaaggtgggcagatcacgaggtcaggagatcaagaccatcctggctaacacggtgaaaccccgtctctactaaaaatacaaaaaaaattagccgggtgtggtggcgggcgcctgtagtcccagctactggggaggctgaggcaagagaatggcgtgagcccgggaggcagagcttgcagtgagc

SEQ ID NO: 13563 - DNA, 249 bp, Homo sapiens
gcgggcagatcacgaggtcaggagatcgagaccatcctggctaacacggtaagaccccatctctactaaaaatacaaaaaaaaaattagccgggtgtggtggcgggcgcctgtagtcccagctactcaggaggctgaggcaggagaatggcatgaacccgggaggcggagcttgcagtgagctgacatcgcaccactgcactccagcgtgggtgacagagtgagactccgtctcaaaaaaaaaaaaaaa

SEQ ID NO: 13564 - DNA, 129 bp, Homo sapiens
cgtggtggctcacgcctgtaatcccagcactttgggaggccgaggcaagcagatcacgaggtcaggagatcgagaccatcctggccaacatggtgaaaccccatctctactaaaaatacaaaaaaaaaa

SEQ ID NO: 13565 - DNA, 1635 bp, Homo sapiens
tataattcttttaatgtgcattttaattccatttgctagtgttctgttgaggatttttgcatcagggatattggtctgtagttttcttgtgtctttgtctggctttggtgtcagagaaatgcaggcctcctagaatgtgtttgaaaagtgttccctctgtttcagttctttggaagatagctgtttgaggaagattgatgttaattctttaagtgttcagcagaattttccagtgaagttctctggtcctgggtttttctttgctgagaggtttttgattactgctttaatccccttagttattataagtgtgttcaaagtttttatttctccatgattcacccatggaaaattgtttttagaggtttatccatttcttgtagattatccaatttgttggcacataattgttcctagtagtctcttgtaattcttctatttctgtgatatcagttgttatgttccctctttcatttctacttttagttatttgaatcttctttttttcttagctaatctagctaagggtttattaattttattgatcttttcaaaaaccaactctaggtttctttgggtttttttctgcttttttttttctatttatttatttttttctatttatttatctgatctaatctttatttttttttctcccttctgctaattttgggtttagtttgtttctttttttcaatttccttgaggttgaagttaggttgctgattttgagatctttcttcttttttttaatgtaaatgtttactggtataaacttccctctttgtatggcttttgctatatatcatacattttggtatatttttttttttgttttcgtttgtttctggatttttttctaaatcccttgtgatttcttctttgacccattggttgtttaggggcgagttgtttaatttccacacatttgtgtattttctgggtttacttttctgctattgacttctagtttcattttgttgtagtcagagaagatacattgcatagttttagtcttcttaaatttgttggtgggcggcactggctcacacctgtaatcccaacactttgggaggctgaggtgggcaggtcacttgagttcaggagttcaagagttcaagaccagtctgggcaacatgacgaaatcctgtctctaataaaaatacaaaaaattcactgggcatggtggtgcataccagtagtcccacctactcgggagtctgaggtgggagtatcagttgagcccaggagattgaggctacagtgagccttgtgctctccagcctgggtgacagagtgaaaacctgtcttaaaaaaaattgttggctgggcacggtggcccacgcctgtaatcccagcactttgggaggctgaggtgggcagatcacaaggtcaggagatcgagaccatcctggctaacacggtgaaactccgtctctactaaaaatacaaaaaattagccgggcgtggtggcgggcgcctagtagtcccagctactagggaggctgaggcaggagaatggcgtgaacccgggaggtggagcttgcagtgagccgagatagcgccactgcactccagcctgggcgacacagtgagactctgtctcaaaaaaaaaaaaaaaaaaaaattgttgag

SEQ ID NO: 13566 - DNA, 148 bp, Homo sapiens; identical to SEQ ID NO: 10886

SEQ ID NO: 13567 - DNA, 3905 bp, Homo sapiens; identical to SEQ ID NO: 7664

SEQ ID NO: 13568 - DNA, 153 bp, Homo sapiens
cactttgggaggccgaggtgggtggatcatgaggtcaggagatcgagaccatcctggctaacacggtgaaacctcgtctctactaaaaaatacaaaaaaaattagccgggcgtggtggtgggcacctgtagtcccagctactggggaggctga

SEQ ID NO: 13569 - DNA, 275 bp, Homo sapiens; identical to SEQ ID NO: 6733

SEQ ID NO: 13570 - DNA, 264 bp, Homo sapiens; identical to SEQ ID NO: 11143

SEQ ID NO: 13571 - DNA, 147 bp, Homo sapiens
atctcagcactttgggaggctgaggcgggcagatcacaaggtcaggagatcgagaccatcctggctaacatggtgaaaccccatctctactaaaaatacaaaaaattagccaggcatggtggcggtcgcctgtagtcctagctactc

SEQ ID NO: 13572 - DNA, 237 bp, Homo sapiens; identical to SEQ ID NO: 11145

SEQ ID NO: 13573 - DNA, 126 bp, Homo sapiens
tgtaatcccagcactttgggaagctgaggtggacggatcacaaggtcaggagatcgagaccatcctggccaacatggtgaaaccccgtctctactaaaaatacaaaaaattagctgggcatggtcg

SEQ ID NO: 13574 - DNA, 1855 bp, Homo sapiens
cgcggtggctcacgcctgtaatcccagcactctgggaggctgaagtgggcggatcacgaggtcaggagatcgagaccatcctggctaacacagtgaaaccccgtctctactaaaaatacaaaaaattagccgggcgtggtggcaggtgtctgtagtcccagctacttgggaggctggagctggagaatggcatgaatccgggaggcagaacttgcagtgagtcaagatcgcaccactgcactccagcctgggtgacagagtgagactccatctccaaaaaaaaaaaaaaaaggggccgggtgcggtggctcatgcctgtaatcccagcactttgggaggctggatcacctgaggtcaggagtttgagaccagcctggtcaacatggtgaaaccccatctctactaaaaatagaaaaaaataaccaggtgtggtggtgtgcactctgtaaccccagctactcaggaggctgagacaggagaatcgcttgaaacgcaggaggcggaggttgcagtaagcagagattgcatgccactgcactccagcctgggcaacaagagtgaaactccatctcaaaaaacaaaacaaaaaaaaaatgaggaagggcatttcttgcttagtgccttttaaacacctaatagaactctctggaagctgtgttggacatgggtgcaagttgcagtatggtgcagtcctggctcagtaggaggttccatcaaccaggagcccctttgttattctgtttctgttttttcatggtggataatgtctatgatgttgtgggtactacataggtgagactatatagcacagcctctacctttataagtggtggcaataagcatgtgattaactgtcatacaaccacagagcaaacagatttcagggaaaaaaaaacacactttagtcctttatcaataacgccccctttctcaatgggctagactcctctttgttcttccctatacctttaaagaatacaactatcagcttacaagaaaaacttttcctaagtccaaggacaggagaggcgcagtggctcacccctgcaattccagcaatttgggaggccaaggtgggtggatcacctgaggtcaggagttcgagaccagcctgactgacataatgaaaccccatcgctactaaaaaaaatacaaaattagccaggtgtagtggcacgtgcctgtaatcccagctactcaggaggctgaggcaggagaattgtttgagcccaggaggtggaggatgcagtgagccaaggtcatgccattacacgccagcctggtcaaccagagcaaaaccgtctcaatcaatcaatcaatcaatcaagtccaaggacagaacaaacaaaagtaaaataccttattcctcttctaagcttcttaaattgctaggccttggtttattgacaaaatattgtcatgattgcatgttttatttgctttacaatggtttcgtggtcttattttatttcaaacacttgatgttatagtaagctatcttctgcatcaatgaggaaaaaataaaactgatatttaaaaatgcattttagaaatttggtgcagtggccaggcgcggtggctcacgcctgtaatcccagcactttgggaggctgaggcgggtggatcacaaggtcaggagatcgagaccatcctagctaacacagtgaaaccccatctctgctaaaaatacaaaaaattagccgggcgtggtggcgggcacctgtagtcccagctactcgggaggctgaggcaggagaatggcatgaacccgggaggcagagcttgcagtgagccgagattgcgccactgcactccagcctgggcgacatagcaagactctgtctcaaaaaaaaaa

SEQ ID NO: 13575 - DNA, 176 bp, Homo sapiens; identical to SEQ ID NO: 11147

SEQ ID NO: 13576 - DNA, 278 bp, Homo sapiens; identical to SEQ ID NO: 7675

SEQ ID NO: 13577 - DNA, 176 bp, Homo sapiens; identical to SEQ ID NO: 11149

SEQ ID NO: 13578 - DNA, 2364 bp, Homo sapiens; identical to SEQ ID NO: 6735

SEQ ID NO: 13579 - DNA, 263 bp, Homo sapiens
ctttgggaggccgaggtgggcagatcacgaggtcaggagatcaagaccatcctggctaacatggtgaaaccccatctctactaaaaatacaaaaaaatgagccaagcatggtggcgggcgcctgtagtcccagctacttgggaggctgaggcaggagaatggcatgaacccggccggcggagcttgcagtgagccgagatcacaccactgcactccagcctgggcaacagagcaagactccgtctcaaaaaaaaaaaaaaaga

SEQ ID NO: 13580 - DNA, 119 bp, Homo sapiens
acgcctgtaatcccagcactttgggaggccgaggcgggcagatcatgaggtcaggagatcgagaccatcctggctaacacagtgaaaccctgtctctactaccaatacaaaaaaaaaaa

SEQ ID NO: 13581 - DNA, 297 bp, Homo sapiens; identical to SEQ ID NO: 7679

SEQ ID NO: 13582 - DNA, 169 bp, Homo sapiens; identical to SEQ ID NO: 11155

SEQ ID NO: 13583 - DNA, 93 bp, Homo sapiens
ttgggaggctgaggcgggcagatcacaaggtcaggagatcgagaccatcctggctaacacggtgaaaccccttctctactaaaaatacaaaaa

SEQ ID NO: 13584 - DNA, 282 bp, Homo sapiens; identical to SEQ ID NO: 11159

SEQ ID NO: 13585 - DNA, 300 bp, Homo sapiens
atttttggctgggcgcggtgggtcacgcctgtaatcccagcactttgggaggccgaggcggacggatcacaaggtcaggagatcgagaccatcctggctagcacggtgaaaccccgtctctactaaaaatacaaaaaattagccgggcgtggtggcgggcacctgtagtcccagctactcgggaggctgaggcaggagaatggcgtgaacctgggaggtggagcttgcagtgagccaagatcgcgccactgcactctagcctcctgggcaacagagcaagactctgtctcaaaaaaaaaa

SEQ ID NO: 13586 - DNA, 131 bp, Homo sapiens; identical to SEQ ID NO: 6739

SEQ ID NO: 13587 - DNA, 128 bp, Homo sapiens
gtgcggtggctcactcctgtaatctcagcactttgggaggccgaggtgggtagatcacgaggtcaggagatcgagaccatcctggctaacagggtgaaaccccatctctactaaaaatacaaaaaaaa

SEQ ID NO: 13588 - DNA, 281 bp, Homo sapiens; identical to SEQ ID NO: 7692

SEQ ID NO: 13589 - DNA, 301 bp, Homo sapiens; identical to SEQ ID NO: 7693

SEQ ID NO: 13590 - DNA, 310 bp, Homo sapiens; identical to SEQ ID NO: 7694

SEQ ID NO: 13591 - DNA, 1635 bp, Homo sapiens; identical to SEQ ID NO: 13565

SEQ ID NO: 13592 - DNA, 145 bp, Homo sapiens
cgggcatggtggctcacgcctgtaatcccagcactttagaggccgaggtgggcggatcacgaggtcaggagatcgagaccatcctggctaacatggtgaaacccagtctctactaaaaatacaaaaattagctgggcttggtggc

SEQ ID NO: 13593 - DNA, 277 bp, Homo sapiens; identical to SEQ ID NO: 7700

SEQ ID NO: 13594 - DNA, 175 bp, Homo sapiens; identical to SEQ ID NO: 6740

SEQ ID NO: 13595 - DNA, 303 bp, Homo sapiens; identical to SEQ ID NO: 7701

SEQ ID NO: 13596 - DNA, 309 bp, Homo sapiens; identical to SEQ ID NO: 7702

SEQ ID NO: 13597 - DNA, 253 bp, Homo sapiens; identical to SEQ ID NO: 10751

SEQ ID NO: 13598 - DNA, 287 bp, Homo sapiens; identical to SEQ ID NO: 7710

SEQ ID NO: 13599 - DNA, 260 bp, Homo sapiens; identical to SEQ ID NO: 10754

SEQ ID NO: 13600 - DNA, 273 bp, Homo sapiens; identical to SEQ ID NO: 7712
  misc_feature (18)..(18): n equals a,t,g, or c

SEQ ID NO: 13601 - DNA, 279 bp, Homo sapiens; identical to SEQ ID NO: 8074

SEQ ID NO: 13602 - DNA, 225 bp, Homo sapiens
tcattgtaggctgggtgcggtggctcacgcctgtaatcccagcactttgggaggccgaggcgggcggatcacgaggtcaggagatcgagaccatcctggctaacacggtgaaaccccgtctctactaaaaatacaaaaaattagccgggcttggtggcgggcgcctgtagtcccagctactcgagaggctgaggcaggagaatggcgtgaacccgggaggcggag

SEQ ID NO: 13603 - DNA, 320 bp, Homo sapiens; identical to SEQ ID NO: 6742

SEQ ID NO: 13604 - DNA, 124 bp, Homo sapiens; identical to SEQ ID NO: 11184

SEQ ID NO: 13605 - DNA, 308 bp, Homo sapiens; identical to SEQ ID NO: 6743

SEQ ID NO: 13606 - DNA, 164 bp, Homo sapiens
aatcccagcactttgggaggctgaggtgggtggatcacaaggtcaggagttcgagaccagcctggccaacatggtgaaaccccgtctctattaaaaatacaaaaattagccaggcatggtggcaggtgcctgtaatcccagctactcgggagactgaggcagga

SEQ ID NO: 13607 - DNA, 300 bp, Homo sapiens; identical to SEQ ID NO: 6744

SEQ ID NO: 13608 - DNA, 279 bp, Homo sapiens; identical to SEQ ID NO: 7728

SEQ ID NO: 13609 - DNA, 287 bp, Homo sapiens; identical to SEQ ID NO: 7730

SEQ ID NO: 13610 - DNA, 266 bp, Homo sapiens; identical to SEQ ID NO: 7732

SEQ ID NO: 13611 - DNA, 322 bp, Homo sapiens; identical to SEQ ID NO: 6747

SEQ ID NO: 13612 - DNA, 5125 bp, Homo sapiens; identical to SEQ ID NO: 10190

SEQ ID NO: 13613 - DNA, 154 bp, Homo sapiens
tgggcacggtggctcacgcctgtaatccaagcactttgggaggccgaggtgggcagatcacgaggtcaagagaacgagaccatcctggccaacatggtgaaaccccgtctctactaaaaatacaaaaattagctgggcatagtggtgcatgcct

SEQ ID NO: 13614 - DNA, 140 bp, Homo sapiens; identical to SEQ ID NO: 11196

SEQ ID NO: 13615 - DNA, 281 bp, Homo sapiens; identical to SEQ ID NO: 6748

SEQ ID NO: 13616 - DNA, 270 bp, Homo sapiens; identical to SEQ ID NO: 6749

SEQ ID NO: 13617 - DNA, 296 bp, Homo sapiens; identical to SEQ ID NO: 6750

SEQ ID NO: 13618 - DNA, 238 bp, Homo sapiens; identical to SEQ ID NO: 11203

SEQ ID NO: 13619 - DNA, 301 bp, Homo sapiens; identical to SEQ ID NO: 7745

SEQ ID NO: 13620 - DNA, 178 bp, Homo sapiens
gtggttcacgcctgtaatcccagcactttcggagggtgaggcgggcggatcacaaggtcaggagatcgagaccatcctggctaacacggtgaaaccccgtctctactaaaaatacaaaaattagccgggcatggtggtgggcgccagtagtcccagctacttgggaggctgaggcagg

SEQ ID NO: 13621 - DNA, 201 bp, Homo sapiens
cagcactttgggtggctgaggcaggcagatcacgaggtcaggagatcgagaccatcctggctaacacggtgaaaccccgtctctactaaaaatgcaaaaaaaattcgctgggcgtggtggcgggcgcctgtagtcccagctactcgggaggctgaggcaggagaatggcgtgaaccctggggggctgagcttgcagtgagc

SEQ ID NO: 13622 - DNA, 192 bp, Homo sapiens
ttagctgggcacagtggctcacgcctataatcccagcactttggaaggctgaagcgggcagatcacgaggtcaggagatcgagaccatcctggctaacacagtgaaaccccgtctctactaaaaatacaaaaaattagccgggcttggtggcgggtgcctgtagtcccagctacttgggaggctgaggcagg

SEQ ID NO: 13623 - DNA, 307 bp, Homo sapiens; identical to SEQ ID NO: 7758

SEQ ID NO: 13624 - DNA, 137 bp, Homo sapiens
ccaggtgcggtggctcacgcctgtaatcccagcactttgggaggccgaggcgggcagatcacgaggtcaggagatcgagaccatcctagctaacacagtgaaaccctgtctctactaaaaatacaaaaaattagcca

SEQ ID NO: 13625 - DNA, 146 bp, Homo sapiens
ggcacggtggctcacgcctgtaatcccagcactttgggaggccaaggtgggcagatcacaaggtcaggagatcgagaccattctggctaacatggtgaaaccccatctctactgaaaatacaaaaaattagccgggtgtggtggca

SEQ ID NO: 13626 - DNA, 1209 bp, Homo sapiens; identical to SEQ ID NO: 7760

SEQ ID NO: 13627 - DNA, 5775 bp, Homo sapiens; identical to SEQ ID NO: 6656

SEQ ID NO: 13628 - DNA, 738 bp, Homo sapiens; identical to SEQ ID NO: 6657

SEQ ID NO: 13629 - DNA, 1096 bp, Homo sapiens; identical to SEQ ID NO: 7766

SEQ ID NO: 13630 - DNA, 293 bp, Homo sapiens; identical to SEQ ID NO: 7768

SEQ ID NO: 13631 - DNA, 131 bp, Homo sapiens
ttttttttttgagacagagtctcgctctgtctcccaggctggagtgcagtggcacgatctcggctcactgcaagctctgcctcctgggttcacgccattctcctgcctcagcctcccgagtagctgggact

SEQ ID NO: 13632 - DNA, 523 bp, Homo sapiens; identical to SEQ ID NO: 6756

SEQ ID NO: 13633 - DNA, 128 bp, Homo sapiens
tttttttgagacagagtctcgctctgtcacccaggctggagtgcagtggcgcgatctcggctcactgcaagctccgcctcccgggttcacgccattctcctgcctcagcctcccgagtagctgggact

SEQ ID NO: 13634 - DNA, 209 bp, Homo sapiens
agtgtgggtagattcatgaatgatgagacagcacatggagacagagaggccatgtggaggagctaaggcatcagatattttagtgcagccattttggactttctaggctaactcagttgaataagtggcactaagatgccacctggagcagaagaaccaaccagctgagccctacccaaattcctgatccgcaaaatcatgagaaataa

SEQ ID NO: 13635 - DNA, 132 bp, Homo sapiens
attcttcacatataggaaaatgtgataaaaaaataaacagaattgatttaagttaaaaaaaaaaaaggtaatatttaacctccgtgggttttccaatttactgaaagcatgaggaagatgcttagccagatc

SEQ ID NO: 13636 - DNA, 380 bp, Homo sapiens
caggtgcccaccaccacacccagctaatttttgtatttttagtagagatggggtttcaccgcgttgttcaggctggtcgcgaactcctgacctcaggtgatccacctgcctcggtctcccaaagtgctgggattacaggtgtgagccaccgcgcctggccttctttacttttgaattacaattttgtcagatataatattcttggctggccagtttttgtttagtatgttttagcactttgaacatatcattccaccctcttctagcctataataaagtttcttctgggaaatctgctgataatctaatagacgttatcttgtatttgttgggtcactttcctcttatggctttcaggattctttgtgacttttgacaac

SEQ ID NO: 13637 - DNA, 97 bp, Homo sapiens
ggggtttcaccatgttggtcaggctggtttcaaactcctgacttcaggtgatccacccatctcggcctcctaaagttctgggattataggcgtgagc

SEQ ID NO: 13638 - DNA, 380 bp, Homo sapiens; identical to SEQ ID NO: 13636

SEQ ID NO: 13639 - DNA, 1686 bp, Homo sapiens
ttccttgtatgaaaagatttaatgaattatgagccattgatcattacaaactttaagccttaatatttcttctttcctatgtaaaaccaggtaattaaaacagcctgtctcagtatgacagaagaccatagtagggataatagtaacgtctgcttccacatctgcatgcttcgttaaccaaccaaagaaagtgctccaggtttcccaagtcaacaaagtatactcagttacactttccctgatcatactatgaattgaaacagaacactcctttgacttttaatagcacttttcatccacggcacaagcactttcccattattttctcctttaccctcaatatccttgtgaggtagtgaagggagggagcaaggatttttttttttctattttgcagatgagaaaactcaaggtgaattttacaacagtggttctcaaccttggcagcatattgaaatgaccagaaagtttttaaaaatccttatgaccagctcatattccagaccaacatcagaatcttggcatacggaacccaagcatcgatgtgtcttccaacattccaaagtgactacaaagtgtatacagccaacactgagaaccactggtttgaatgatttacactcaatcttcaggcgcaactgtcttctaccgaaatgctctcctcagcaccaatgacaaagatattccatctccttgagcactgcagcagtttaagattttgtagagctactactgggttttagtgacaaatttacgtaaatgaaggccctcatgacccagatgctcatgctgctcacttcaattgcatatgatttgcgaatgggacattcgggaatttaaatctttgagataagaatggcttgttgttaaatattgaggcaattatttcattctaggtccaatacgcaataaccatgtgtttcggttttccactcagcaccttcaaaactgttgcaaatgaatgtttactaacaagacaaaagagacaattataaaccaaactctcaacaaaattcggaatggccacatcacaacctgaaaaagaaacaagtacttaaaggacttgatcacttcctaacaagtccatcttcaacctgaaccacttctcttgtttaatcaaattttaaactttgccgaactgagttgttctacaccaagaaaaatcaatttctataccacctacattctctaatacatttaacatataatttcactcaatacaaggaggtttcttcttaacctggacatcgaaaagaatctttaacagatttcatcttttcaagcaatgtatcaaatacacaataaatacttgtaaacttttcaggtggcaacaataaatctttgttctatggctgaaatcccttgcttcacaggagtattgacaatcttaactcccaaggagcaatccaagaatcccggccagctgctgggtgtccctaatcagatttaaaacaaaacatacatacagcaagaactcagaagtacaaagatttcgctcgcttttgtcaattcttatgtatctaaaaccatacaatttatactttcatacagaaagatgtctgtttcttttctaacaaaagaaaaactctcagctcatgtgggttggattattaattcaaaagcattttagtgatgagaaacaagatttgtaagtcaaaataggagttaatgttaaactcttctaca

SEQ ID NO: 13640 - DNA, 729 bp, Homo sapiens
gaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatac

SEQ ID NO: 13641 - DNA, 184 bp, Homo sapiens; identical to SEQ ID NO: 7785

SEQ ID NO: 13642 - DNA, 500 bp, Homo sapiens
gagatttcttacttgttgatcacttattctggtacctttccccaaatgatattactgatttaattaggagatacaggttagagggtgctctttggccaattgtgaatacagtaattgatcaaaaaaaaaaggaggatggaagtacgtacacacatattaacatgataattatagctaaagtggtactcttttttaatagcagtgcatcctagagagtaaaatatgatggttctcaagaaacattctgctggggaaaacagtgtttgaatcttagtattttatggaactgcttttttgcttttataaaagcaatttttgtattgacttttggaagaaaatcagttccaataaagcacacattttcatttgtatatctgtcagaagctgatagatttactatactattctgttttgaataataaaaattgcaggcataattaaataaccaaatagttatcccaatgagagagttgctgtatagtttaagagacagatgttca

SEQ ID NO: 13643 - DNA, 577 bp, Homo sapiens
attagtctggctttaaacttaaaatccacacactgtcttattttgacaactgtgcaaaaaatagaacacaggaaaagatagcccatggaatgtgagaaaatattgcaaaacatatatctgataagggattcacatgcagaatatagttgtcccttggtatatgtgggggattggttctaggacctgcctgtgtataccaaaatttgctcatacacaaatcccgcagaacctgcatatatgaaaagtcaaacataggtttcacattctgtgaatactgtattttcaatcaacatttggttgaaacaaagtctgtataagtggacccgtgtggtttatacctttggtgcgcaagggtcaactgtatgtaaagaactcctacaactcaacaacaaagaaacagtctgtttcaaaaagaagcaaaggatttgaatagacatttctctaaagaagatatacaaatggccaataagcacataaaaaaatgctcaacatatctactcattagaggaatgcaaatcaaacgtacagtgagataccatttcacacccattgtggtggccattataaaaaaaaaaaa

SEQ ID NO: 13644 - DNA, 4205 bp, Homo sapiens
ggccctgattttgttgtttgtgatgaaggccatattctaaaaaatgaagcatctgctgtttctaaagctatgaattctatacgatcaaggaggaggattattttaacaggaacaccacttcaaaataacctaattgagtgtgagttaatatctctgattatgcagtagaatattggtatttcctcagatatatttttgtaacgttaccatttacctttcttctacttattctagtatagtcctagaccatgatctacataggttcatcttagtctgctgtgaaagaataacatacttttcaaatgagatgctttataaatgagtggtaaaatacagttaagagatacgctattgtgaatgttcatatataaatatggaatgtgaattattgcaagagtatcagaagtcttaatgattgctttagaaagtacataagcatatgtgattactccagataattttaaggggatattccagttttggggcatgtactgtcaagaaatcagaaagaaatgggaactgtgaacattttagtaaagtggagatgggagaaggagaggtttgctgaatccatggcaggacagtttgctgaggctaaaggtagttgatgtgaacctagggaaatgacttgtgaattaccctcattttcgtatgtctgtggtgacactaaagaagggaacatgagattattcagcaagtaactaattgaaatttcctgttataatctctcactttttttctttttcccactgtaatggctttttgttatttttctctgtgttacattcctttagtgtatttatggtaactttttgctattttattatttgtaatactagtcatttcactttagcctatactttatgtttgtttttatctgttccagttttcctcttttctattctgttaccctatttatagaaatgctgtttcatattgtggtcctatatagtatgggacaagtgatggctctgttaatttttacaaaatgggttagtcttacaaaatacattagtaattaattttttttttttactatttgtgtagccccaactgaatactgaataacagttgttattatttgatctctcaaatattatttggttattctggaaatgaatcagttaatataaattaacttgcttagtagcttattacctcctatttattgttttgacttagtatctcctttcttcacaagatagcctcactgaccataaaatcatggttagattaatggaccacttgttttatacttcatatctcttataaagaataatagtgagtttgaataaactgtccttaggtatttttaaaaaacgttcatgtctagtatttagggatggtttttacttcaattttctctctcgttttggtaattcacttgtagatcagacttataaccatgtttattctatacttagcttgatattctttctttatagcttaattctaatgcatgtgtttttgacatgagcatttcattggggaatttttctaagtctttttaacgattgttaatgttgttaatgaataatgtcttctctcttagatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcaggtacaaatatgttccatagtaataaaatattcttacttttttatataacaatcccaacatattttctgagcttaaagtttaataattttgtgttttctttcccgctctttcagtagatagttttacagttatatctccttgcgttgtcttaaaaaatttctgctgcattcaacttttaaaaaagaagttccgctgagtttaaaacatagttgattcatttgccaggtgtaaagcctcatatcttattatgttaatgtttagatttttcatccttaagatagggagttccttaagaggaacatagctactatgatgaagttcctatgctcaccctaattctgtagtacagtattataaatctcacttttttgaaatggttataggagaggccagtatgaattaagagaggagccacttttaaagtaatcctggagaaacagttttgttactttcaagtatatataataacctgaacagactagtggtgtcgtttacatacagattttcagtgaatctatattaatgaatggataagtgtctagagactgagctggcagttaatagatctcaagatacgcactttctctgtagatgttaggtactgatgatagcctcaaagatgttttaacaaatgagacaggctattcttttggttggatatacagtttgccctccatatctgcaggttctgcatccatggattcaacctaccatggatcaaaaatatttttttaaaaaatagataaaatggacagaggctaggtacagtggtgcacacctgtaattccagcactttaagaggccaaggtgggaggatcacttgagcccaggagttcaaggctgcagtgagctaaaatcatgccactacactccaggctgggtgacagagcaagaccctgtctctaaaaaaagttttaaaaaattagccagccacggtggtgcgcacctatagtctctgtcacttgggaggctgaggcaggaggattgcttgagcccaggaattcaagactgcaaggagctaagattatgccactgtacttcagcctcaatgatagagtaagaccctgtctcttaaaaaaaagaaagaaaataattaagaaaaaaatggatgattgtgtctgtactgaacatgtacagacttttttcttgtcattatttcctaaacaatagagtatagcaactatttacatagtatttgtattgtgtgaggcattataagtaatctggggatgatttaaagtatatgggaggatgtttatatgttatatgcaaacactacattatttatataagtgacttgaactttcatggattttgctatctgtggaggtggggtgggttctggaaccagtctcccatagatactgaggcatgactgtacttgccatcattataaggagtagttgttccgtttggtcaggttggctacatgtgctagcaagtaccctgtttctgtattgctgctactacccaggcagcatttttctttctggtttaaggagtaatttctatttagcacattggtgttctgtttttctactcttacaataaaatggtttcaagagtgcttgtagaggggttgctttcttaattgggcaaatattccctctaaaattatatgttattgtttgacatattagcatatctttctaagaagccaactcagactgcattagactttgattcctaggttttattacatgattaaagcaaggcattttgctcacactacctactacatcccctccataccttttgttatttttttttctgtacagagaagactattttgaaaacttaaattgctcacttggtaatgtgattgcttcaatttaaaacctacctggtgtgttgcagtgtctttttaccagtgtaccatattgtatagtcatatgaaatacattgtgtagataattgtgggtttagaaagggtaaatatatttaagaaaatgttttcttatatgtttagtgcctatttatttatgtgtatatttcagttataagcaatgagaacttgtagttcattcctgttaaatatttagattaattttcattctctttcttgttaattacagaggaaagattatacagcattaacaaaattcttgcctccaaaacacgaatatgtgttagctgtgagaatgacttctattcagtgcaagctctatcagtactacttagatcacttaacaggtaaacaatacaccttgttgatttcatcttctctataaagacattctttttccaaagaagattatttcagtcatcttactatgtctgttgttctttttcagttttgcatttgaataaaatgggtatgcttaaaagcataaaatatttctaattaaaacactgatgctgtcaaaattaaaatcaagaagcaaattgatgaaaaagatatacagcacatatgaataatgcccttaatttgtaaagagcttttatttcagaaaaattatgaatgtgaataaatccat

SEQ ID NO: 13645 - DNA, 6186 bp, Homo sapiens
gctttgttcatacctctacagaaaacctgctaacagttgaattgtttgtacctcttcccactgccccacctccagctttccccagactgaatgtacttacgtagtcaaatacgtttctaagttgcctggattacttctgtatttcttttttgttctcttcctgcgattgtggtattcatgggaaatgcaaataggttgatttgttttgttttagcagtttttctcctttcccattctcactgatgtttaattttattctttgaatatgtagaatattatgtattttgtatagtaaaaactattaaaaaggctatatactcggagtctctctctttctcccatcccttctgctccattctccacactcctcccttgtaggtgatgaacctcattgttctctggtttatcgttgctataaagagaaacacatacgtgcttgttttcctgttttctttcctacacgaaacgtagcatgtatattactctttttcactttgaccttttgactttaggatatacagattgctccatatcaattcagaagcgctcctcgtcctttttcagtactccgttgtgtatatgctccagtttatttaaccagtcttctgtgcttggagatttatgtaggtttccagattttgcagttacaattaatgctataatgagtcactctgtgcatgtatgttttttatattgttggaggtgtatcttcattataaattcctaaagtaggacttctgggtaaatgcatatgtagttttgatagatattggcaaattccccttaaaaggggctgtgccagtttgcattcccagcagtgtatgagagtgcctgtttcctccacagccttatcaacagtgtattgtcaagctttgaacatttgctaatatgacaggtgagaagtggtgttttacagtagttcttatttatctttctctcattatgaatcaagtcgaatgtttaaggaccatttaaaagaattgtttgttcatctttttacctgttttcctgtatgatttgtagtttatttttcttcagtttttgaaaatatatcagtcttttgttgcatatgagtcatcattagaaagcttcctctatactcaggccagagaggcatttacccatgttttctggcatttgtacagcttttttatatttagagctctattccatatggagtttattcatgtgtgtatggtgtgaagaatgggatctaattgtatcttttttttttttttttttgtgagacggagtcttgctctgtcaccaggctggagtgcagtggaacgatctcggctcactgcaacctctgcctcccaggttcaagtgattctcctccctcagcctcccaagtagctgggattagaggtgcgtgccatcacgcccagctaatttttgtatttttactagagacggcttaaccatgttggccaggatggtctcgatctcttgacctcgtgatccgcccacctcagcttctcaaagtggtgggattacaggtgtgagccactgcacccagccttaattttatctttttccatatggcttcatagttgttacaacactattaaaaggaccatcttttctctggtaatttcagatatcatctgtatcattaatttctgtgtctacctgggacaatgtctggacttcctgttctattccatttgcctgtctatgtaccaggaccatactattttaattatagacgtttaataatatattttaatatgcaggttgccttcttcctcatctctgcagtaactgtcttcatggtttcatagccttctccctgatacccctccccaggtactaattttttctctttagttttgtctgtcctctgctgattttgtctaacttttcataataaaaaaaagttttgcctaacttttgtcctacttatgaatttttctgtcttcttcagagatttcttctgccctcttgtttgtttttccatgactgggtgacattgtttaaaaactgattggtgttgcccatggttctgtgcatcatttcaccttgccctatgctaagctgttatgcaagaatagaaaagctcattgttccattgaaaatccagggttctagcattttaacattagttccacaggggcagaaattttgtcatattcattgttgtatccctagtacttaaaaaccggtacatggcacatggtacctgtcacacagtatgttgtcagtaaatgtttgtcaagtgaatgttgttcattgttattccagtttgtttttgtttttttttaagagagtgaataggtgtccttttcattttcttggtttagtgtcacatttgaagacgagcactgaggatgaggaaccaactgaagaatatgaaaatgttggaaatgcagcatctaagtggccaaaagtggaggatcctatccctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaagacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaa

SEQ ID NO: 13646 - DNA, 434 bp, Homo sapiens
ggaggaattggtgacatctgggcaggacgttgaattgggttttctgagagaggagtaggaactaggatgacctgagtaaaggcagctacggaagtgcccaggcatcctccagcaaggctggtctctggcagggctgatgtgtgggcaggaaggagggtgccatggagtactcgttccccgtagtcgtggggacatggattgggcttccttttgctgaagatgagaccagctttggttgtttttaacctgaggtttccatgtgctcctcacacaggagagctcccgtacttgagctccagctgaacctaatgcactgtctacttttggggagatgcaggctaaataacaaaggagaggatggccacagctcaggtggggattctgagtgcctcagccccactaagcaccagacaagctcctactgcggcccccat

SEQ ID NO: 13647 - DNA, 1754 bp, Homo sapiens
atttcttagaactgcatgtgaatctacaactagctcaaaataaaaagtttaattataaaataaaagctacatgaaatgaagcaaaaaataattcacccttgtcacgcacacagagtcagagactgtaacataatttgcaggatctagagcagaatacaaatgtaaaacatcttgttaaaaaattattaataattttgagacattgataaagcattaagccgcctgtggggccctttaagcatgataaactgtgctaccacacagattgcacattcacgtatctggccctgcaaatggaatgatttttgcccatgatcaattcaccatggcctctttgggctcagtgaatttgcttcttcaggagggtaattttctcttctttctctgctaagctgtttaacagtagttgccctgcctaatgggcttcatccatccatttctctcagattattttcatgatgcactaggatgaagcacaccctttctcctagtcttgaggaaacgtcgatattcagaatatttaaacgcaggcactgaccaatcagaagagtttctggccaacgttccacacttgagggaaatgacattatctgagccctgaagaaaaacgttgtagatattctccagatcaaagcatcgacaggaagattttagatgttgaagttcgtaatatttcctaaagcaggtatgaattactagtaacttaataggtatattaactgatgaagttttcatttctcagaacaaaccagtcaaggaaggtgctattatactccttttattcatatagatcttgaggctgagacagtttaatcaatatgctataattattgtgtaataataaattaccataaactaggggtgctatgatctcaatatttgtatctcccactcccaaattcacatgttgaaatcctgactcccaaggtgatggcattaggagatgaaacctttgtgaggtcattaagtcatgagggtagaataccgatgaatgggattagtgcccttacaaaaggggcccaccaaagctgccttgttccttctactatgtgaggacacatctagaagttaccatcaatgaaccagaaagtgggcccttaccaggcaccaaatctgccagcactctgatcttggacttccagcctcctgaactgtgagaaataaatttctgttgtttataagttacccattttatggtattttgttacaggcacatgaactaagacaagtggattaaaaacaacacaaattattattttactgtctagaaatgagaggttcaaaatggctaaagtcagggtgccactgatagggctgcatttcttttggaggctctagggaagaagccgtttccttgcctttttcagcttccagaggccacctgcattccttagcttatggtcccttgctacagctttaaagccagcagcacagcaccttcaaatctctctctgacagtgacattcctgccttcccctaataaagacccatgtgattagattaggcccacctggattatccaaaataatccctctgtctttagacccttaaccatatgtgcaaaatgtcttttgtcatgtaaaataacatccttacctcaaggttttgggaattagcttattaatgtctttagggggtcattattctgctttccacatacatttaaaattaactatcaggctacaaaagtcatatatgaattgagcttgttttgccccaaaggctgtgttctttttttattttttttattttta

SEQ ID NO: 13648 - DNA, 178 bp, Homo sapiens
catttgtagacatttctctcgcacaaatgacaacttatatttacacaaaagcctgtatataaaatgtgcataacagctttattcataatagtcaaaacttgtaaacaactgtatgtctcacaatgggtgaaaaattaagtaaattctgttataggcatacagtggattactactcagc

SEQ ID NO: 13649 - DNA, 38771 bp, Homo sapiens; identical to SEQ ID NO: 6652
  misc_feature (7892)..(9416): n equals a,t,g, or c

SEQ ID NO: 13650 - DNA, 6335 bp, Homo sapiens
gcacagcagcatgggggaagccacccagcagtggcagcgggtggggagatcaccctgcagagccgccggtggcatttggaagagctggcgcacctgttgctgcctcagccctgtgcaaaccaggtaagcctagcatcctgcttgccctgatctggcaatttggaaatgactcaaagtattgaattttaaagattagagttttaggatactttcctcattatatttacactttaactacaaaccaagagtcttggccaagcacagtgcctcacacctataatcccagcactttgggagtccagggcaggaggatcgcttgagcgcaggagtttgagaccagcctaggcagcatagtgagaccttgtcactacaaaaaaaaattgaaaaattagccaggcatggtggcacatgcctgtaatcccagctattcgggaggctatggtgggagaattgcttgagcccgggaggttaagactgccctgagccatgactgtaccactcatgagcctgagcaatagagcaagaccccatctctttaaaaaggaaaaaaaaaaagccaagattataaaatatttgccatgcctgatacatgaacacaaaggagcttttaagagatgtccataccctccttttataataatacaaataaatgcaaaagtcaaagcaaccccgcatattatgtttgattctcctggtaatacccacactacttcagcagtattcttgtacctgccacattaagtaatttaaacctgctatttcactgagcaagatagataaaacatgtcatctccttgagattagtttttgaaaatatgtattacctcacagcagcctaacgcatcttgccgtattgccctgctttcatcttgtcaacagaattccactgggtggaatttgccatgtttgttttaaagttgtttatgcctaaacaacttgaaaaaattttaaaaaggtacattttcctcccattttctgaaagtgtagcaaatatgcaggtaataagtatccttataaatgtccagattatgtataccaagtggaattcttatatgggtgttttgcaatgtgatatttgtaatattaacatgagtataagattactgatttaaatctgatattaaaattaattgtggctgggcatggtagctcacgcctgtaatctcagcactttgggaggccaaggtgggtggaccacctgaggtcaggagttcgaaaccagcctggccaacaaggtgaaaccccatctctactaaaaatacaaaaattagctggacatagtgatgagcgcctctaatcccagctactcaggaggctgaggcaggagaatcgcttgaacccgggaggcagaggttgcagtgagccaagatcaggccactgcactgtagcctgggagacagagactccatctcaaaaaaaaaaaaaaaaattcgttgttcacataactgcagaagcttcatcttttctttggacattattagatgtcctagatcttaaaatgcaactttattggttttgtactttgtggttttttttggttttttttgttttttgttttgctaatactcgatagtatgttccatatagccaccactctgctcaaagtattccatttatattacttttttttacaaacctaaaggataagggaacttgtgagtatttagattcatgcgccattttgagcattctattttgagaatttgtccttggaggcacagttatgtgcctattccatatgtttatcagccttgtatcttcattgaagacccagctaactgtgctcttacctagtctttgcccttcttcatattcttccaagaagtgaaaatttggggtaattttgataccgaaaatcactttgtattttaagataggaggaaaaaacaatatctgaagtggaaactcgatagtcactttgtagctccatctgcctaaggcctccatcctgctagtctgtaagcatctcctgcgggcttgttagaaatgcagcctgtcgggcccaacctcaggcctgccagacttcacatgatccagctgactgtcacgagtggacaggtttgagaagctctggtctgtgtgacttaatgctcataggtttggatcaagcagtgattaagaatcagacagagatgctcatttcagcagcacatgtactaaaattggaacaatacagagaagattcgcgtggttcctatgcaaggatgagatacagatttatgaagcatcccatatacaaattttcctgccacttgtgatggctcatgactgtaatcccaacactttgggatgccgaggcaggaggactacttgagcccaagagtttgagaccagcctgggcaacatagtgagaccccatctctattaaaaagaaaaaaaaaattagctggatgtggtggcacatgcctgtagtcctagctacttgagaggctgaggcaggaggatcacttgagcccaggagtttgaggttgcagtgagctgtgattgcactactataatccgggcaacagagcaagaccctgtttcaaaaaaaagaaaaaaacctacaaattttaaaaaccacacaggacaatgaaatgttttaggaatctacatttctgtagccttttcataccatgtagagattgccaccttccctggtggccccaggatttgttcttagcatgtttatgtttcagaatgatgtgtagttggttaaggaagtttagaacagcacagagtacaaatagctgatgtttgaaggaaaaattatatacatatacatgtttatttacatatgtagcaagagaaattcaattctgagatctgggagaaatgaaggcataaaaaggtagattacaatgcatcatttgtcccacgacccctaaattatatgttacagtggaagcattgtctgcgttagggacatgaatttgataagttcatgtttgctctgtttctagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaaggtaagtacaacactcttaacgacggtacaccctgaaaaccaaaggtacttcagacacattcagtatccagttaatcagacaaaaagatagacctgaggttctcaaagtagtcttaggacccttggaggtcccagagaccctttcaggggagtaagcaaggtcacaactattatcatgccagtactaagactgtctttttcatttgaagtctctctccggtatagggtagaggtgtccagagaactttattgtagcagagaatgtgcagaaacaggcatgaaaatccagccatttctcttaagccagacatagagatttgccaaaaggcaaaacagtgccacccttctcatgaaaaattaattactttttattttaaaatgttaggttaatgtgtagtgactattatttttaagcaaaattatatttttaaattttctcagttttaatttctaatacagtaaatagcaatagacacaactcatgtcaacagaagttctttgggatcttcagtctctaagagagtattatagggtcctgagaccaaaaagtttgagacagatggttaagaagtcttaaaacagatgggcaggcagggcacagtggctcacacctgtaatcccggcactttgggaggccaaagtgggtggatcacttgaggtcaggagttcaagtccagcctggccaacatggtgaaaccccatctctactaaaaatacaaaaactagctgggcgtggtggtgggtgcctgtaatcccagctactcgggaggctgaggcaagagaattgcttaaacctgggaggcggaggttgcagttgcagtgagccaagatcgcctcactgcactccagcctgggcgacagagcgagactccctctcaaaaaaaaagacacaaatgtgcggtcatctagaaaacactgagatacacatctcatatatacatgagctacatgagacgtgtatctcatttttttctagatgactgcccaattcagtccacattcagcatgactgaatttcaagtaggtcacaaacttaaatattaaaaatatgaaaacatgaaagaacattaaaaacaattttggactcagagaggcctaactatgaccaaaatctaaaagccataaaataaaatttttttgtgtcaatagataaatgtaaaaactgtacatgacagaaaataccataatcaaagtcaaaagaaaaatagcaaactggaaaaatatgtttataactcatatcatagagagggccaatcccctgatacataaagtcctagaaactgatttaaaaaaaaaatcagccagaaacccagtagaaaaaggagcacagaatgtgaagagtagctggtccacagagaaggagcaccagtggctcctagacacggactcacaggaaggcagtgcagttccagacagcactcagagacacctgccatttttcatctctcagacccacagaaagccagcgttttgatttttttatttaaaaaaatttttttagagacagagtcttgctgtgtcaccttaggggctggagtacaaccttgaactcctgggctcgaattgtcctcctgcctcagcctcctgagtagctgggtctacaggtgcatgccactctgcccaactaattttattttttattttttctgtagagacagagtctcactttgtggcatttatacagttttgtattgcagcatttttgtagtaaaaagataacaataatttatgtgtacattgatggagtaacaagttaattatgtcacttctacattatacagaactaaaaggaaattctatctatgtattgatatgaaaagatcactaaagtacattgttaaattaaaagcaaggtgcagaaaaacatgtacagcacacaccctattttgtggggtaggaggaagaaaacgtgtgtgtgtgtatgtgagtgtgtgtatgcatgcatgcacacgtagtgtatcagcttctacagaatgttctaaattctctggaagggcaaataagaaactgctatgagtagtgcctcttcgagagaacaggaactaagcaaatggggtggcatgagatgaaaactttctttataccttgtttatacttttgaatcgtgtgaatgtattcatgttcaaaaaaatatagtttataaaagcattcagttaataatcagcagaaaccagaaactaaaatcagagctctccgctcatgaggagtagaagtgattacagacatcaaaaagaatcctttttacagttgggctggcaaataatccagttaatgatgggaccaaaaatagcaaattggtaaattaaaatcttgactaatctggctctggcagcatagtaatgattgaaatagccccaaaataagctagttccttgaggaaagaaagcctgtttatagagctccatatgctccatgatatagctgtggcaggctcaattgtgaaaaacactatgaagaatatttttggaagggaatttttttcatattgtaataatgcatcattagaacctttgcatttataggctcagagggaagttattgagaagcctcctggctcttctgtggtgccgagccctcccccacccccactgctctttctgtagctgacctttttcctcatcctctccttcactgacattttcctccttattccttttctctaccctatgagctataagtaacaaatagttaataaaattaacaggttgtttcatcctttcttcttgctgcctctttactcattggaataaaccccctcattttatcatttttcagaataaagcttagaaaaggcaaaaagtgtaatttttagtaaacttcacatagggctgtgttcaagggagcgcttaggattattggatagtaaaagtagtctatatttgtgataaactaaattaattatctgggaaagagaaataattatcttgctttaagttcataaattgcacatatataccaacctgcaaatgtaccttgatgctttccgtagcagtagccacgaaatactgttagggagtttctggaatacagcattattcaatgttaatacaaaaagatcctgtgacttttaaatgaccctgaatttaggctgtctcccatttctggtagaaatgcattaaaatgtagctcatggacttccccctttcccacactttgttcaagggcatgaagacgtctggcaagcaggatgaggcctggatcatgagccggctgatcaaacaactcac

SEQ ID NO: 13651 - DNA, 5775 bp, Homo sapiens; identical to SEQ ID NO: 6656

SEQ ID NO: 13652 - DNA, 738 bp, Homo sapiens; identical to SEQ ID NO: 6657

SEQ ID NO: 13653 - DNA, 325 bp, Homo sapiens
gaaatgtatttccagttccaaaacctaataactatgtctttaagttgatagtgattaaattgtttgtaacctttccttttgttaattaatgtgcactaatgaaaactctgttttcctacacagagagagccagctgaggaggccttgaagagtaacaatatgaatcttgatcaggccatgagtaagtcatacaacatcctttttaaaaaggtacccagctgtgaagttttactttccagaagcatttgattgtagtcatggtttaatggttaatatgtcctgggtagacaggaccaggccacagtgaaggggcaaccacacaaca

SEQ ID NO: 13654 - DNA, 1562 bp, Homo sapiens
ggagagctcccgcttcctgtttatatttcacaagcgtcaaactctttagcaagtgtgagaaatgcctccttttctaactgctaactggcatgacctcacttcggggctcagagatccctccctgccagaatgtacttttgctggccaaaggcggggaccggggtccgccctggaaacgcgctttcaatcttgggcgacctgcttcattgtgtgattttaataaggatgaagggctgtcacggctgcgtcaaaaccacggttccagcaggaaataagcactgggagaggacaggacacgtacccccttccgccgacaccccccacccgatggcaggagggagcccaaaccttgcagcttccatggctcatggctcatgacaatatcattcttaaaattctttgagtttatcaatacgttttgcccttacctgccctacaactgtaaataacaaaatgtatgcatttcctactttttatttgttccgaatgtattctcaagcttcaagaacggttcccatcctaccagacttccaccgtatcaggattaaaaaacaaaacaaaactctgttattctctccatagcttatggcttttaaaaaataataatttgaacaaacaattcctacgtggcatagatctttccatcctggagaatgttactatttcagtctgtcatcttttgtagatattaaaaacctttcgtatgtcaatttctttgctcctcaccaccaccttttaggcaggtactagtattagctcgatgcatttgacacgtgtttattgttattcaatgccagacactgaaataggccctagggatgtataacatattctgtttggaaaattgaggctcaaggaggctaaataacctgccccaggttatatagtctgggattcagtctgagacaggcccccaggtttgttggactccaaagcttgtgctcttaatcactatacttacggttgcctggtagggttgtttgggttgtgcaccgctcaactccagggggagctattcacattgcagtctgtgtgagagcaccctctggagttgtgcaatgtggcactgagcagctgcactgggtaatcctgccattttgtagccgtccctgctgttttgtctcttctaagtggggagagaacataatttcgtacaagagaaagatgggatctttctcttctttcctattgggactcagcatcttggtggccttacactgtgtgctgaatgagtctatactgttactatctatagtaactcccgggcccttcctgtgcaagaatttagagccccaagctcccctatacatccccacaacttgcttgctcagatatcactttttacctgcttatgaagcctcaaaaatttttatctcagctcacggtaagaaatacattttacatcatgtctcaatacacacacgtatgtctttacacacatcttaagtatatttaagcatagggcagccaaagcttggttgggctatagcaataagtgaccgctaccctctctcctatactcctgagtaaccattgctctcttaaaaaagaaaaaagaaaaa

SEQ ID NO: 13655 - DNA, 65 bp, Homo sapiens
acgccactgcattccagcctgggcaacaaagcgagactctgtctcaaaaaaaaaaaaaaaaaaac

SEQ ID NO: 13656 - DNA, 84 bp, Homo sapiens
gtgagccgagatcgcgccactgcactccagcctgggcaacagagcgagactccgtctcaaaaaaaaaaaaaatagaaaagaaaa

SEQ ID NO: 13657 - DNA, 283 bp, Homo sapiens; identical to SEQ ID NO: 7561

SEQ ID NO: 13658 - DNA, 147 bp, Homo sapiens; identical to SEQ ID NO: 6794

SEQ ID NO: 13659 - DNA, 143 bp, Homo sapiens; identical to SEQ ID NO: 7597

SEQ ID NO: 13660 - DNA, 170 bp, Homo sapiens; identical to SEQ ID NO: 7598

SEQ ID NO: 13661 - DNA, 125 bp, Homo sapiens; identical to SEQ ID NO: 7605

SEQ ID NO: 13662 - DNA, 162 bp, Homo sapiens; identical to SEQ ID NO: 6214

SEQ ID NO: 13663 - DNA, 301 bp, Homo sapiens; identical to SEQ ID NO: 7637
  misc_feature (98)..(98): n equals a,t,g, or c

SEQ ID NO: 13664 - DNA, 246 bp, Homo sapiens; identical to SEQ ID NO: 10003

SEQ ID NO: 13665 - DNA, 193 bp, Homo sapiens; identical to SEQ ID NO: 7396

SEQ ID NO: 13666 - DNA, 140 bp, Homo sapiens; identical to SEQ ID NO: 6216

SEQ ID NO: 13667 - DNA, 246 bp, Homo sapiens; identical to SEQ ID NO: 7658

SEQ ID NO: 13668 - DNA, 153 bp, Homo sapiens; identical to SEQ ID NO: 6795

SEQ ID NO: 13669 - DNA, 61 bp, Homo sapiens; identical to SEQ ID NO: 6218

SEQ ID NO: 13670 - DNA, 193 bp, Homo sapiens; identical to SEQ ID NO: 7690

SEQ ID NO: 13671 - DNA, 136 bp, Homo sapiens; identical to SEQ ID NO: 6219

SEQ ID NO: 13672 - DNA, 279 bp, Homo sapiens; identical to SEQ ID NO: 8074

SEQ ID NO: 13673 - DNA, 300 bp, Homo sapiens; identical to SEQ ID NO: 6744

SEQ ID NO: 13674 - DNA, 150 bp, Homo sapiens; identical to SEQ ID NO: 7399

SEQ ID NO: 13675 - DNA, 322 bp, Homo sapiens; identical to SEQ ID NO: 6747

SEQ ID NO: 13676 - DNA, 142 bp, Homo sapiens; identical to SEQ ID NO: 7400

SEQ ID NO: 13677 - DNA, 177 bp, Homo sapiens; identical to SEQ ID NO: 7751

SEQ ID NO: 13678 - DNA, 368 bp, Homo sapiens; identical to SEQ ID NO: 6222

SEQ ID NO: 13679 - DNA, 131 bp, Homo sapiens; identical to SEQ ID NO: 10092

SEQ ID NO: 13680 - DNA, 2925 bp, Homo sapiens; identical to SEQ ID NO: 6223

SEQ ID NO: 13681 - DNA, 4706 bp, Homo sapiens; identical to SEQ ID NO: 7776

SEQ ID NO: 13682 - DNA, 4704 bp, Homo sapiens; identical to SEQ ID NO: 7404

SEQ ID NO: 13683 - DNA, 1445 bp, Homo sapiens
cacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcatt

SEQ ID NO: 13684 - DNA, 88 bp, Homo sapiens
ggaggttgcagtgagccgagatcgtgccattgcactccagcctgggtgacagagtgagactccgtctcaaaaaaaaaaaaaaaagagt

SEQ ID NO: 13685 - DNA, 98 bp, Homo sapiens; identical to SEQ ID NO: 11303

SEQ ID NO: 13686 - DNA, 57 bp, Homo sapiens; identical to SEQ ID NO: 10936

SEQ ID NO: 13687 - DNA, 136 bp, Homo sapiens; identical to SEQ ID NO: 6219

SEQ ID NO: 13688 - DNA, 1161 bp, Homo sapiens
tcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctat

SEQ ID NO: 13689 - DNA, 164 bp, Homo sapiens
ctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgag

SEQ ID NO: 13690 - DNA, 561 bp, Homo sapiens
taggcacacatgtgcatgcacacttccagcctcctcttcctgctggtgcttctcagtgatacctatgagaaggatcactttccttccttatttccttttgtgggataggatggatctaaaagggacacattaataagaaggcatagtgattaatgtattcagcaaaggttttttccagtcttctcttattaagaaacagactttttcccttgaaatgagatttcattggccttctttatgtaagcttattgtgccagcaattgtgcttgttgcagtaaaagaagattccctcttttgtgggggtgttaaaaatcccacctacatacatccacacaattttaccttagatacccagttcatagtgtgaacaccactgtcttaagtggagatttagtttaaaaaaaatctttttggctgggcacagtggctcatgcccataatcccaacactttgggaggctgaagtgggcagaattgcattagcccaggagtttgagatcagcctgggcaacatggcaaaaccccttttttacgccccccccccccaaaaaaaaaaaaaaaa

SEQ ID NO: 13691 - DNA, 558 bp, Homo sapiens
taggcacacatgtgcatgcacacttccagcctcctcttcctgctggtgcttctcagtgatacctatgagaaggatcactttccttccttatttccttttgtgggataggatggatctaaaagggacacattaataagaaggcatagtgattaatgtattcagcaaaggttttttccagtcttctcttattaagaaacagactttttcccttgaaatgagatttcattggccttctttatgtaagcttattgtgccagcaattgtgcttgttgcagtaaaagaagattccctcttttgtgggggtgctaaaaatcccacctacatacatccacacaattctaccttagatacccagttcatagtgtgaacaccactgtcctaagtggagatttagtttaaaaaaaatctttctggctgggcacagtggctcatgcccataatcccaacactttgggaggctgaagtgggaaaaattgcactatacaatatgtttgagatcagcctgggcaacatggcaaaaccccttctctacgcccccccccacaaaaaaaaaaaaaa

SEQ ID NO: 13692 - DNA, 1335 bp, Homo sapiens
taggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttcttttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagtc

SEQ ID NO: 13693 - DNA, 184 bp, Homo sapiens
caaaaatgaaattatttcgtaatgaaagataaacattttaatatttagaggatatttggtccttaaaacacagttctcaaaccagttgtcttgaattctatatggaacaatgagagggtataaataaagttctgaaagggtatccaagggagagaatacagtcatgggttcttagtttctgttt

SEQ ID NO: 13694 - DNA, 1334 bp, Homo sapiens
taggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagtc

SEQ ID NO: 13695 - DNA, 184 bp, Homo sapiens; identical to SEQ ID NO: 13693

SEQ ID NO: 13696 - DNA, 7852 bp, Homo sapiens
ctatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaattctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacaggtaatttctgcagaagtgaaattaaatttactgctttaaaaattttgagaatcattattttcaatacagaaattcctcattaggatttggcattggcctgatgtttagcaggaatacaagaaatctaaaagggtcttgtattctgcaactggaagtatctcttattaataaagacactagcctgtttaagagtctagtgggcttagccatgttcttcaactactgccagtacttgagcaagatttcagaatgatctatttgtttcagacacagtggtagaaacactgtgtcatcatagttgttactgctcttttttcctcactggtatcacagtctcagcagccagcaaagacttaattgtgaaaatgcacaaacctagagtaatacgtttaagttccacgttctgaactctaccccatcctctgtgctatcagaataaaaccacacttgatgacatgagttgatttttttctgagccctaatggtttctcctcgttggagctagtttgttaactaaatcagaaatcaatttgctttttgtgtaggtggttttattctgttaggtagaactagtcattgttaaacttctgtttatcacttcctactgttaggaatgatggaactatcaaatgttatttgatggctttagtttctgatcagattaattcttttccttccgtctttttgacctgctttttataaacaacttttatcataaacaactgttagtttaccaagcaattaaggatgttgtgcatattctatagcatggtgcttcttcattacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaa

SEQ ID NO: 13697 - DNA, 10562 bp, Homo sapiens
atagtgaggactcagaagacaaagatgtgaagaccaagaaggatgattctcactcagcaggtagtaaactattttaaatgtaagaggtataattatatttgtatattattttattagatgttttaataagtgatttctatgccaggcactgttgcaaatctgggattacaaagacgtttccatcttcaaagagctcctaatgattgtcagtcctggtggcttattacagtcatctatgaatcttttttaaaatgcatattctgggtcctgtcccaaaatttctgattaaatagatctaagtgggatgttggggcttggttttctttaagtatctatacattattcttatgcacagtcaatattggaaatcatttacgtaaacaaaagacatcaaactaaatagaataatatataaatataaaacttggtaaaataggggcataaaaagggggagtggtggactctgggtggaaaagcaaatgaaagtttcattcccactctttttagtggagacatagccttttgtaacagtagccatagagaaagttttttttgtaaaaattttaacttaaattaatatgaattaatggggagtctccatggccaaataaaatgttcagtcctgatgattctacttgttgttggtatttatttttaaatttaatcttctaagaattgagatttttaatccatattacttccagccactttagttttgacctacattcccttgctgttgtctccctggatctccctttaaatgagactgctgtttagctaatacaaaggggagagacaaagttctgctaaattcactctgcttagctgttttgctttccctcctattcaagtatactatctggctacctaagttgaaaagaaactgtattaatcttttgcactatctggtgatcctgtgataatagagtatatgctttcagtcatttgccttgtaaatcctagtttgaatctcttacacttgctagtttattgagcacttctagataaataactctgtactagtattaagctaagcttctaccaagtgggtttagttttgggtcggccatgtcagctttattctgtttgtctctagatgagatttttaaaagtgaaagagatgacttgaacactgactatggcaaggctcatgggactagaagtgttttcagaaaagggctgtaggtagagactaaggcaaatatggtttagtctagaggcagtaggctggcagcctaccctttaaccaaatttattcacaaacacaactgtgtgttaaaaaaattttttttaggctgagcatggtggctcccacccgccatcccagcactttgggaggccaaggtgggtggatcacctgaggtcaagggttcaagaccagcctggccaacatggcaaaaccctgtctctatcaaaaatacaaaaatttggctgagcccggtggctcatgcctgtaatcccagcactttgggaggccaaggcaggtggatcacctgaggtcaggagttcgagaccagcctggccaacatggcaaaactccttctctactaaaaataaaaaaattagccgggtgtggtggtgggtgcctgtaatcccagctactcgggaggccgaggcaggagaatcacttgaacctgggaggcagaggttgcagtgagctgagatcccactgttgtactccagcctaagcaagaagagcaaaactccatctcaaaaaacaaacaagcaaacaacaacaagaaattagccgggcatggctgcatgtgcctggagtcctagctactcgggaggatgagacaggagaatagcttgaacccaggaggcacaggctgcaatgagccaagattgcaccactgcactccaatctgggcgacagagtgagactccaaattaaaaaaaaaaaaatttttttttcattaatagactctaagaatatgtgaaagtaaattttttataggcttctccaaatgtctttcactaattaatctaaatatgtattttaaagattttccagctgggcgcagtggctcacgcctgtaattccagcactttgggaggccaaggagggtggatcacctgaggtcgggagttcgagaccagcctgaccaacatggtgaaaccctgtctctactaaaaatacaaaattagccaggagtggtggtgcgcacctgtaatcccagctactcgggagggtgaggcaggagaatcgcttgaacctgggaggtgaggttgcagtgaggcgagattgcgctatattgcactccagcctgggcaacaagagcaaaactccatctcaaaaaaaaaaaaaaggttttccacaatcccctctaaattgaaatggtcacaagccattcattgtaaagggtaacagtttgacattattttagggttttcgtgttttatgtcttagaataaagattattggaagacattctttctctctcatactatgttaagatatttttctaactttagctttcaaaaacagtgaacatagatttgaatgtaattgagaattgtagagcaaagcaatgatgtaactttaaagtataggagtcatgtattcacgctttaattcagcttgtctactgcttaaaattacattcccttgttactttatatgtaatagtggttacatagtcttgtccaagttcattctttgtgaatttaggtcccctttatacattttgtagaattttttttttttttatgttgtgggatacatgtgcaggatgtgcaggtttgttacatacgtaaatgtgtgccatggtgatttgctgcacccatcaacccatcacctaggtattaagcccagcatgcattagctaatttttaatgctctccctctccatccccccaccctgccccctccctcgccacaggccccagtgtgtgttgttcccctccctgtgtccatgtgttctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaatcctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacaggtaatttctgcagaagtgaaattaaatttactgctttaaaaattttgagaatcattattttcaatacagaaattcctcattaggatttggcattggcctgatgtttagcaggaatacaagaaatctaaaagggtcttgtattctgcaactggaagtatctcttattaataaagacactagcctgtttaagagtctagtgggcttagccatgttcttcaactactgccagtacttgagcaagatttcagaatgatctatttgtttcagacacagtggtagaaacactgtgtcatcatagttgttactgctcttttttcctcactggtatcacagtctcagcagccagcaaagacttaattgtgaaaatgcacaaacctagagtaatacgtttaagttccacgttctgaactctaccccatcctctgtgctatcagaataaaaccacacttgatgacatgagttgatttttttctgagccctaatggtttctcctcgttggagctagtttgttaactaaatcagaaatcaatttgctttttgtgtaggtggttttattctgttaggtagaactagtcattgttaaacttctgtttatcacttcctactgttaggaatgatggaactatcaaatgttatttgatggctttagtttctgatcagattaattcttttccttccgtctttttgacctgctttttataaacaacttttatcataaacaactgttagtttaccaagcaattaaggatgttgtgcatattctatagcatggtgcttcttctttacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggctatgcctatacatacagagactgggatatgtgaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaattcaataagtcccccaaaacaaagctttaattgccagatgaatacaaacacacactcacacgtacacacccacacaatacttcaggggtttttatacatgttattttagggcataagctgagtactatacccccacaccccatcaaaaaaggaacaacaaaaaaatgacaattttaccctcccccaataatatagaaaaccctcccttcaccc

SEQ ID NO: 13698 - DNA, 608 bp, Homo sapiens
ctgaactacaattcctttttttggggggggtggggatggagtcttgctctgccacccaagctggagtgcagcggtgcaatcctagctcactgcaacctctgcctcctgggttcaagtgattctcctctctcagcctcccgagtagctgagattacaaccatgcaccaccacgcctggctaatatttgtatttttagtagagacagggtttcaccatgttagccaggctggtcttgaactcctggcctccagcaatctgcctacctcagccacccaaactgctgagattacaggcgtgagccaccacgcccggactacagttccttttaataattttagatattttagcagtttttcttgtgtatatttagtgatctttatttgccatcaacactatgtatttttagtatttttatactctgcctctgttcgagaatatttttcttattaaatattcttgtgaaccaagctttatccataggtgaaaaaattccagcctgtgttgagacagcttctttttttcctttgagtctttggaagcagtgttttgtaacgtaaataaaattgtgcttattcaccagcatccctgtaaataaggaaataaagtac

SEQ ID NO: 13699 - DNA, 3367 bp, Homo sapiens
ggtgagttatgcatatctgaaaatgaaagaaggcttgtttctaaagaggcttggagcaaactgcagcagtactttccaaaggctcctgagtttccaagttacaaagagtgctgttcacagtgcaaggtactgaacgctactgacatctggggaaatggcatgccacctccctgggttgacttcccaggggaattaacactgtacttctgacgggggtgtagggaggaggcaggtcatgtgctgtcagcaggagacagttgattgcttcattctctttcagattttagaaagagaaggggaagaaaatgaagccttacataagatgattgcaaacgagcaaaagacttctctcccaaatttgttccaggataaaaacagaccgtgtctcagtaactggccagaggtataatgattcccacaaaagaaagaatgcatcttttctttttaaagcccttgccaaattcccagtgagctatttcagaacaacccagaacttctcatattctcatttgtttagttatctaaccaggggatttactccagcctgctattttttggtagaggactgtgttttcattttatttataaaacttgaataaggacaaccaaagtatattataaggaatttgtgttaagcaggcggtgaattgacggatactgttttgtgatttttgtgttctaggatacggatgtcctctacatcgtgtctcagttctttgtagaagagtggcggaaatttgttaggtagaaacaaaatatgttttatttcctttattgttactgatttggttgcctctggtattttttaagatatcgtggattctgtttgttgtacccttccttcatggttactttcaccagcatacactgaaagctttcttttctattaaattaaatgaataagcctaagaaacacattgaattactaatattttcttaaatatatctctgattttgaaataattattttaaaatcttctctttcgtcatgcagtaattaggtatatttctcctccttgtctcatttgagtagaaagcctacaagatgcagccctgtgtcatcagttgggaacagtgctcttttgtgtccccacgggggcctcatgtttacatttgcttccatgaccaaagaagattctaaactgtgagttccttctcttcatgtgatttttttttcttcttttctctttttgatgattaataaaatatgtttaggaaatttctcatctgacatagtctgttttaagaatttagtcctttgctgaattgtggggtttttttttccccttttaaaagagaagaagactgcttctccaggaaagacaagaggctgcccgaggctatttgtctttttgctctttccttgtccctcttgaagacaacacagccaccctttctcttcccccgctgctggtgaccagtgctgagacctcttttccagaatcacagaatcaacatggtcttggttataggttttgttctgccatggccaggcttcagacaattaaaggaggaggctagcagggtggcagagcaaagccactgcactggtcatctggaattctagggtcttagaacccaaattttattccatgcttcaagtacttccagaggtgttcatctgtgaatttctcccgattttaccaaaaatcgtgatatacgagaaggtagaatgcttccaacattgtcagaaaatcaggaaaaggaaattggaacacataaataaaaatgcccttggggttaagctagagttttattattcatatttcagtactttaacatcatttaagggagttcaaagtttatatattctctacattttctccctcctctttctctccctccctctctgcatcccgccttccctgttgctctctcactctcgctgtgcatctctcttctctttcctccctccctttcttcctgtcgttgttattgcaaatgtcagacttccaggaaaatacaccagtaagcaaatgtgtgttaccattcagtttaaaagttaaatggttcaaatatgattaaaggccccacagtgcttatccttctgttgctacttctctttctcccacccttcctctcacactaaccactgtactgaatttagagtttatctgtctcagaaagtattctgtaaaaaaaaaaaatgcacgcacataatgtcttgcatatttaaaactttttatataaatggcaccatactgtatttatacttctgcaactaacttattttactcaattatgtttttgagatctaaccatgttgattcatgtaatttcagtccatttagtttcgctgctgtggtaacattcctttgtatgaaaaactattctttgttgatgatacgtatcttttctctctaattcctttggattaaatgttagtgttaatggttttggtttagcagactaatggattatgttaattctcttaatttccatgtgtcttaaggcatgttgtgttttttttttgcacagtatagctctcatatggcccagtgagtggcaaatgatacaaaagctctttgttgtggatcatgtaattaaaatcacgagaattgaagtgggagatgtaaacccttcagaaacacagtatatttctgagcccagtaagttttcatattgctttcggtttctatagttaagagctgacattttaagaagaaagggtgtgtcagtgttgtctgcttaaagttaaagatcatgcggcggtcccaactccctaggtggaaactctcattataatcatcccattatttgtacgtttatttatggacagtaaatggatttccttatcatttgcatgtaatagaatatagtggttaatagaaaatattattaagagtttgggccagcacactagctcatacctataatcctaatactttgagagactagggtggaaggattgcttaaggccaggagtttcagaccagcctgagcaacataacaagaccttctctctacaaaataataaaaatgtagcacatatctgtagtcttgagctactcgctgagaggctgagtcaggagcatggcttgagcccagaagcttgaggctacagtgagctatgttcataccactgtaccccagcctgggtgacacagcaaaaccttgtctcaaaaaaagaaaatgttactaagagtttaatgaatattcactagtaactttgacgtatgtttttagatctttgattctttaacaatgattcctcagccacttctgttttcccttttttttttcccccaaagaactctgtccagaatgcagagaaggcttattgtgtcagcagcagagggacctgcgtgaatacactcaagccaccatctatgtccataaagttgtggataataaaaaggtactggtc

SEQ ID NO: 13700 - DNA, 5347 bp, Homo sapiens
ggtgagttatgcatatctgaaaatgaaagaaggcttgtttctaaagaggcttggagcaaactgcagcagtactttccaaaggctcctgagtttccaagttacaaagagtgctgttcacagtgcaaggtactgaacgctactgacatctggggaaatggcatgccacctccctgggttgacttcccaggggaattaacactgtacttctgacgggggtgtagggaggaggcaggtcatgtgctgtcagcaggagacagttgattgcttcattctctttcagattttagaaagagaaggggaagaaaatgaagccttacataagatgattgcaaacgagcaaaagacttctctcccaaatttgttccaggataaaaacagaccgtgtctcagtaactggccagaggtataatgattcccacaaaagaaagaatgcatcttttctttttaaagcccttgccaaattcccagtgagctatttcagaacaacccagaacttctcatattctcatttgtttagttatctaaccaggggatttactccagcctgctattttttggtagaggactgtgttttcattttatttataaaacttgaataaggacaaccaaagtatattataaggaatttgtgttaagcaggcggtgaattgacggatactgttttgtgatttttgtgttctaggatacggatgtcctctacatcgtgtctcagttctttgtagaagagtggcggaaatttgttaggtagaaacaaaatatgttttatttcctttattgttactgatttggttgactctggtattttttaagatatcgtggattctgtttgttgtacccttccttcatggttactttcaccagcatacactgaaagctttcttttctattaattaaatgaataagcctaagaaacacattgaattactaatattttcttaaatatatctctgattttgaaataattattttaaaatcttctctttcgtcatgcagtaattaggtatatttctcctccttgtctcatttgagtagaaagcctacaagatgcagccctgtgtcatcagttgggaacagtgctcttttgtgtccccacgggggcctcatgtttacatttgcttccatgaccaaagaagattctaaactgtgagttccttctcttcatgtgatttttttttcttcttttctctttttgatgattaataaaatatgtttaggaaatttctcatctgacatagtctgttttaagaatttagtcctttgctgaattgtggggtttttttttccccttttaaaagagaagaagactgcttctccaggaaagacaagaggctgcccgaggctatttgtctttttgctctttccttgtccctcttgaagacaacacagccaccctttctcttcccccgctgctggtgaccagtgctgagacctcttttccagaatcacagaatcaacatggtcttggttataggttttgttctgccatggccaggcttcagacaattaaaggaggaggctagcagggtggcagagcaaagccactgcactggtcatctggaattctagggtcttagaacccaaattttattccatgcttcaagtacttccagaggtgttcatctgtgaatttctcccgattttaccaaaaatcgtgatatacgagaaggtagaatgcttccaacattgtcagaaaatcaggaaaaggaaattggaacacataaataaaaatgcccttggggttaagctagagttttattattcatatttcagtactttaacatcatttaagggagttcaaagtttatatattctctacattttctccctcctctttctctccctccctctctgcatcccgccttccctgttgctctctcactctcgctgtgcatctctcttctctttcctccctccctttcttcctgtcgttgttattgcaaatgtcagacttccaggaaaatacaccagtaagcaaatgtgtgttaccattcagtttaaaagttaaatggttcaaatatgattaaaggccccacagtgcttatccttctgttgctacttctctttctcccacccttcctctcacactaaccactgtactgaatttagagtttatctgtctcagaaagtattctgtaaaaaaaaaaaatgcacgcacataatgtcttgcatatttaaaactttttatataaatggcaccatactgtatttatacttctgcaactaacttattttactcaattatgtttttgagatctaaccatgttgattcatgtaatttcagtccatttagtttcgctgctgtggtaacattcctttgtatgaaaaactattctttgttgatgatacgtatcttttctctctaattcctttggattaaatgttagtgttaatggttttggtttagcagactaatggattatgttaattctcttaatttccatgtgtcttaaggcatgttgtgttttttttttgcacagtatagctctcatatggcccagtgagtggcaaatgatacaaaagctctttgttgtggatcatgtaattaaaatcacgagaattgaagtgggagatgtaaacccttcagaaacacagtatatttctgagcccagtaagttttcatattgctttcggtttctatagttaagagctgacattttaagaagaaagggtgtgtcagtgttgtctgcttaaagttaaagatcatgcggcggtcccaactccctaggtggaaactctcattataatcatcccattatttgtacgtttatttatggacagtaaatggatttccttatcatttgcatgtaatagaatatagtggttaatagaaaatattattaagagtttgggccagcacactagctcatacctataatcctaatactttgagagactagggtggaaggattgcttaaggccaggagtttcagaccagcctgagcaacataacaagaccttctctctacaaaataataaaaatgtagcacatatctgtagtcttgagctactcgctgagaggctgagtcaggagcatggcttgagcccagaagcttgaggctacagtgagctatgttcataccactgtaccccagcctgggtgacacagcaaaaccttgtctcaaaaaaagaaaatgttactaagagtttaatgaatattcactagtaactttgacatatgtttttagatctttgattctttaacaatgattcctcagccacttctgttttccctttttttttttcccccaaagaactctgtccagaatgcagagaaggcttattgtgtcagcagcagagggacctgcgtgaatacactcaagccaccatctatgtccataaagttgtggataataaaaaggtactggtccctcttgtggcaatgactagtaatgatcaagcgtgctctttggcttgatttgctgttgtatttgcactgagggtctgcctaggactgcatttttgttccttcagagctgtttggcatcagaattgaaattggacaataattgaaaatgaacagttatgtgattatatgagaatttagtttgttattaattgatgcatagatatttactgaatgtcagctgtgttccaggaatggtccaggtgctggggatacagtgataaagaaggcaggtataataccttctctcaaaattataggcacctagtgaggaagatcaggaataaagtataaattcatatgatttcacacagaaatgattgttttgaaggaactttagcagggtcaagtggaggttagtgtgagacagggagtagacaggagaggcgtcttggagaagttgtttttacccaagccctcactgtcagggatgcagcctgggaagtgttttccagacaaaggaaacaaaggtcaaaaggataagcctaatgtgcttatgcaacagagtgaaaaccattgcacctagaacagtgctgtccaatagagcttcctgtggtgatagacaggttctaggttctgtatctgtgctgcgcactgcagtagtcactggccatgtgtggctgtggagcattcgatgtggctagcgtgactgaggaatttagttttagttgatttaaaattaaatagctacatgtggctaatggctaccctagtggctattgctggtctagaatgaaatttattccaagaagggatcatgatatggaatgaacgaccatacactatcaggttttatacatcataccaaggatttgggtttattcccagtgtagatataagcccctggagagtttcaagcaaggtcatgatatgatctgatttatagtttaaaaaaaatcaccctggctatagtgtttggaattgctgtgagggcataacagaaataagagaggtcagttagagcctcttccattgacctgcaaggataggtgaaattgattggatatgtttgggaagtggaggtgttaatacttgcttggattggatttccaagcatttttattatattagggatggctcttgggtagatcctgacccatatctctagatatcttattaatttatttaattccatgctttctgggattaaagacaaaatggaatacattttatttgatgcttgtttccaaacacattttttagaagggtaacttataattatgccctggaggccaagggttctgctttacaagctaaataaactaaggccttcatttcctaatttgccgagaaaatgaagttaatgagtataaatgtctctgtttctccctgtaaaattttcttaaatcttttgttctctggtataaaatattatccaatttagatgtagtttcattattcagtttaataagagtatttcatagtgtttgcaagagagcgcttcttccatctttcgttttctcaattcttaaagagcatgtaactcctgccacttgaatagtttgagaacttgaaaaggcttggcaatcagtgtgctcgggaaggtgtcaagcaccttcgaacttctgcaaaataacatcattgtacaagactgataataataactgctctgcagagacctcttaaatgtatggtgagcacattaaatactacaagaataagtcatagggtaaaaaactaacatgttaaaagagcatagaaaaccgtgaaggcttgattcttgatccactctccagtctataatcccaccatgataaaggtgttcctcgtcttgataaaggttgccggtcccagcccccacatcctccatagcctgccttcctagggtctgacctacttctctttgttgtcctggcacattcaggtgatgaaggattcggctccggaactgaatgtgagtagttctgaaacagaggaggacaaggaagaagctaaaccagatgg

SEQ ID NO: 13701 - DNA, 102 bp, Homo sapiens
tttttttttttttttttgagacggagtcttgctctgtcacccaggctggattacaatggtgcgatcttggctcactgcaacctctgcctcccgggttcaagc

SEQ ID NO: 13702 - DNA, 1569 bp, Homo sapiens
aatgaaccttaattttcttttttttttgagtcagagtctcgctctgtcgcccagactggagtgcagtggtgcgatctcaatttactgcaacctccgcctcccgggttcaagtgattctcctgcctcagcctcccaagtagctgggattacagatgtgcaccaccaggcttggctaatttttgtatttttagtagagacagggttttcccatgttggtcaggccggtctggaactcctgacctcaagtgatccactcacctcagcctcccaaagtgctgggattacaggtgtgactcaccacgcccagcctgaagcttaattttcaagacccaatctgagggtctgggagggaccctagcaatgtgttcacttggttaatttttaaaaagttttattggtatataatatatgaatgagaaaattcataaatattataagtgtgtagtttaagatttttcacaaactgaacacacatatataactagcatccagatcaagaaacagaacattgccagtatgtggtcacatatctttgaagaatttgcaaatgtaagttatctaaaccacagtcagctaaaattgccgtctttttacctgacttcccctttgttacactcttccttatgttgggtggcattggaatggctgtgggcacttttggggtctggctatggggaaattgacttggagagatatttagttggattttagcaggatatgtttacatggttcatagcctctttgtgtatagtcaaggtattactagccatcccagtatgggaatggtttctaggaatactctatgtctgttgtgctaactcatggggcattgtgacataaacgtgcatagctagaggttgtctagcaatatgaatgtgtcctatggcatctggcacccaaagtgtgtggttagtagaggaaaaacaaggtttgatgtcaaaagccagtctggggaaaattctttaagattttgtagctttaatgaaagagacttgttaagaattttcccaggtttgaccatagtcctaaaagttgatataacattatttattgatgatgttcctgtgctaaaagaaaacttttctaagccatcaataacaacaggctgagcgtggtggcttacgcctgtaatcccagcactttgggaggctgaggcaggcagatcacttgaggtcaggagtttgagaccagcctgcccaacatgacgaaacactgtctctaataaaaatacaaaaattggtcaggcgcagtggctcatgcctgtaatcccagcactttgagaaactgaggtgagtggatcacttgaggtcaggagttcaagaccagcctggccaccatggtgaaaccccatctctattagaaatacaaaaattagtcgggcttggtggcacatgcctgtaatcctagctacttgggaggctgaggtaggagaatcacttgaacccaggaggtggaggttgcagtgagccgccaagatcgtgccactgcactccagcctgggcaacagagtgagactctgtcaaaaaaaaaaaaaaaaaaaagaaaaaggaaaaaaaaaaaactcatggg

SEQ ID NO: 13703 - DNA, 1569 bp, Homo sapiens
aatgaaccttaattttcttttttttttgagtcagagtctcgctctgtcgcccagactggagtgcagtggtgcgatctcaatttactgcaacctccgcctcccgggttcaagtgattctcctgcctcagcctcccaagtagctgggattacagatgtgcaccaccaggcttggctaatttttgtatttttagtagagacagggttttcccatgttggtcaggccggtctggaactcctgacctcaagtgatccactcacctcagcctcccaaagtgctgggattacaggtgtgactcaccacgcccagcctgaagcttaattttcaagacccaatctgagggtctgggagggaccctagcaatgtgttcacttggttaatttttaaaaagttttattggtatataatatatgaatgagaaaattcataaatattataagtgtgtagtttaagatttttcacaaactgaacacacatatataactagcatccagatcaagaaacagaacattgccagtatgtggtcacatatctttgaagaatttgcaaatgtaagttatctaaaccacagtcagctaaaattgccgtctttttacctgacttcccctttgttacactcttccttatgttgggtggcattggaatggctgtgggcacttttggggtctggctatggggaaattgacttggagagatatttagttggattttagcaggatatgtttacatggttcatagcctctttgtgtatagtcaaggtattactagccatcccagtatgggaatggtttctaggaatactctatgtctgttgtgctaactcatggggcattgtgacataaacgtgcatagctagaggttgtctagcaatatgaatgtgtcctatggcatctggcacccaaagtgtgtggttagtagaggaaaaacaaggtttgatgtcaaaagccagtctggggaaaattctttaagattttgtagctttaatgaaagagacttgttaagaattttcccaggtttgaccatagtcctaaaagttgatataacattatttattgatgatgttcctgtgctaaaagaaaacttttctaagccatcaataacaacaggctgagcgtggtggcttacgcctgtaatcccagcactttgggaggctgaggcaggcagatcacttgaggtcaggagtttgagaccagcctgcccaacatgacgaaacactgtctctaataaaaatacaaaaattggtcaggcgcagtggctcatgcctgtaatcccagcactttgagaaactgaggtgagtggatcacttgaggtcaggagttcaagaccagcctggcccccatggtgaaaccccatctttattagaaatacaaaaattagtcgggcttggtggcacatgcctgtaatcctagctacttgggaggctgaggtaggagaatcacttgaacccaggaggtggaggttgcagtgagccgccaagatcgtgccactgcactccagcctgggcaacagagtgagactctgtccaaaaaaaaaaaaaaaaaaagaaaaaggaaaaaaaaaaaactcatggg

SEQ ID NO: 13704 - DNA, 38771 bp, Homo sapiens; identical to SEQ ID NO: 6652
  misc_feature (7892)..(9416): n equals a,t,g, or c

SEQ ID NO: 13705 - DNA, 1694 bp, Homo sapiens
atttaatagctctttgaacctaattcagttcttttcatggtcttacctcaatgcaggtccaagacaaagtttctaggcctgttccttgctatttgccccagtgtagctctccagacaaaatggccttctttcacttactgaaaggcactgggttatttcctccctcgctgtcttcatctgtgctatgctttgtggctgatctttttgcctggactattcaccgttctgctcttctcttcctcttgcccctctccgtcttttcctgctaattccagattacctttaagatcttagtttggatgtcattgtcctagggacacccatcttgacacctatattatattaggttaatttttccagaatgtgctttcataagacaatctatacttctcagcatttaacataattgtaatgaattaattacttgtgtaattattctttaatgcctgtcttcttcactagattgtaagccttctgaaggcagagaccacatctgtcttctattgctctggcttctaggacagtgcctggaaagtagttgtttagccataagtatttattgaatgaatacaagggctgtgctgtgctaggttctcattcattcagcagacatctgtggagcacctgctctgtgccagccccttggcatgagaggaaggtgggacataccaagattaacaaatcgaggaaatcgcatctgctagaggagcaggaacatagactcctgtaactgtagcccatggcaggaagtggagagtaaatatggagatgaagttagaaaggcaagtaggtggtttttgatgctgctttcttgttcaataaattgagtacctgctgtgtgccggggctgggcattcagtagtgaagacgagagaattcctaccttcaggaagattatagtctagcagggaaaagaagcaaagaaaccttttcctcctaggccaacaggtatttatggagagagtaggtgagcactttgaggtggtccttttggtctaagaatctgtattgagacttcacacttcattagacctgggcgaggcagttaaaaatactctcattaaccagagtgaaattccaagggaaaaggaagggaggataaggaacattgtttcctctcattgcatctgtggttaattcaggctctgaaatccttcccatgggtcatggacctatggtttcctatcctaagttggaatatgtgcagttaaatacctaaccattctcagtgtgccattgtctcatttgattcccacatagccctctgaggtgcacaggcaggaatgcctatttttcagctgggcaaacaggctctggaaggcagacttgcccaaggtgacacagtttgaactgggaagggatcagaaatctctctggctggctgggtgcggtggctcatgcctgtaatcccagcactttgggaggccgaggtgggcggatcacgaggtcaggagtttgagaccagcctgaccaacatggtaaaaccccacctctactaaaaatacaaaaaaaaattagccgggcatggtggtgcacgcctgtaatcccagctactcaggaggctgaggcaggagaatcacttgaccccgggaggcagaggttgcagtgagccgaggccaagatagtcccattgtactccagcctgggcaacagagcgagactctgtctcaaaaaaaaaaaaaaaaaaaaagaaa

SEQ ID NO: 13706 - DNA, 5775 bp, Homo sapiens; identical to SEQ ID NO: 6656

SEQ ID NO: 13707 - DNA, 738 bp, Homo sapiens; identical to SEQ ID NO: 6657

SEQ ID NO: 13708 - DNA, 1707 bp, Homo sapiens
tctgatgatgtgtgtatttcagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtaagtttgtgccagttggggagggagagttaatgagcctgttctctccctactatatttgatagcaagacttttagttaaccctctcttgaaatgtcagtcatagtgggtctgagtttgccacatcagtggaaatacataggatattaatcaggactcttgcaattgctgtgacagaaccccaacttaggcttacctaggcaaaaaagggaatgatgggctcatataagtagactgtaggaagagaaggacaattggaaccagacttaaatgccgtcaggatttgttcttcatcctcatttctgtctctctcttggttggtgggtctcatcttcaaactggcctactttccaaggttagaaccataagttgttttttttttttgtttttgagacaggatcttgctctgtcgcccagattggagtgcagtggcatgatcatggctcactgcagtctcaatcttctgggctcaagagatcttcctacctcagtgtcctgagtagctgggactacacacatgcaccactatgcgcagctaatttttttttatttttatttttttgggacagagtctcactctgtcacccaggctagagtgcagtggcaccaacacggctcaatggcaacctcaatctcctaggctcgagtgaccctcctacctcagcctcctgagtagctgggactacaggcacacaccaccacacaattttgtttttttagtagagacggggtcttgctatgttgcccaggctggtctcaaactcctgaactcaagcgatcctcccactgtggccttccaaagtgctggagatataggtgtgagccacggcacccagtcagaaccacagctcttgacagctctgaccttgtgtgtgttcagccttgtcacctatgagaataggactgtgtttgagttgctccctcagtcccttaccctggtgccaaactgcagtttgaaaaatcctggagagggattccaggcctggggagaagtaacaaaatgggaagttcccaccagaaatacattgttagaatgggagtgggaaggccatcctcaaaagccagggttaacaagagaaggaaagggggtaagtgcttgggagacaaaaacaatagatgtctgatgtaaatgggcagtggaatccagtactggtttgctaataacagcactcttaattccttttgtttttaaaatgctttcatgtacatcatctcattggatccttctgacagccctgtggttatgtagttagagtcagaacaacagggctgagtctgttctaatgttaggcagtgcttatgtgagctgcaaggtagctgagccttctcaggacatggcacccaaggtgcttgctgaggcgtgggtgggtagactatctgtgcattcttccttggctctgtacgtgagggagattctcgctggacagttgtggagtgttccagtcccactgggactgtctctgttgcaggtgcatcagcgggtaagcgagtgtttacgggtgttgaagatcctgcaagaggtcactgctgggcagactgtctt

SEQ ID NO: 13709 - DNA, 1105 bp, Homo sapiens
gggattataggcatgagccaccgtgcctggcctattctgtagtcttttgtatattacttaggattttctacaaatgcttatgtcatcagataataaagatagttttacttttctcttgcctgttcttatttcttttatttgtttttcttacctcactgtactgggaagtaacaccagtataatagtgaataaaaatggtatgagcaggtgcacatggctttttcttgatcttggaagggacttttttatactaacattaattttttaaaaaaaaattagtcttatttttcaacctgacttaagtcatttaataattactaggaaccaagattttgttgttatttgtcagcatagtaatccttttaagattatattttaaatttttttagaatgaagaaaatgtgcctttttatatgttatttggacttttgataaggaggaatcgaagaattgcatttgagaatattctcagagttcaattataaatctttttagaagaaatttaaagaaaatattaatagtaattctatcagatattcatcaatacatataatttgatttggtttaattaggtaaggtataggatgcaagaacaacaaaatagaattgataggtgtaattatagaaagatactggtagctgtgtgttgttttttctcttagacacagacacagaatttaacacctggaaagcagcatggaactgttagcagtttatatatatataatagtggtcattaaagaagaaaataaatgtttgtatgtattttgtttataattttagaagtacagttcttttaagcctgcacaataagctttttaagaaaggtatatataagtttaacttggccggcacggtggtggcaggcagatcacttgaggtcaggagttcgagaccagcttaaccaacatgctgaaaccctgtctctactgaaaatataaaaattagctaggtgtggtggcacgctgtaattccagctactctggaggctgaggcagaattgcttgagcctgggaggcagaggttgcagtgagctgagatcactccaccctactgcagcctgggtgacagagcgagactctgtctcaaaaaaaaaaaaaaaaaa

SEQ ID NO: 13710 - DNA, 1105 bp, Homo sapiens; identical to SEQ ID NO: 13709

SEQ ID NO: 13711 - DNA, 119 bp, Homo sapiens
ctgggctcaagggatcctcctacctcagcttcccaaagtgctgggattataggcatgagccattatgcctggcccaaagttctttatattttctagatgttaattcttcatcagatagg

SEQ ID NO: 13712 - DNA, 119 bp, Homo sapiens; identical to SEQ ID NO: 13711

SEQ ID NO: 13713 - DNA, 102 bp, Homo sapiens; identical to SEQ ID NO: 6331

SEQ ID NO: 13714 - DNA, 93 bp, Homo sapiens; identical to SEQ ID NO: 7562

SEQ ID NO: 13715 - DNA, 607 bp, Homo sapiens
gacagattcattttgcctgatgtcaaattccataggaatggaatctcatagtatctatcatttgcgtttggcttcttatattcaacatagtgtttttgaggttttttttttaatgtgcttgtaccagtttattttccttttttattggttagtagtattttatttggaatgtaccacagtttatccattcacctcttgatggacatttgagttgtttgtcatttttggcaaaacaagtatttatctcaagaagaatgtgactggagtgagacctagccattggtgggtaaaaaactagcaccaaaggcggggcgcggtggctcaagcctgtaatcccagcactttgggaggcaaggcgggcggatcacgagaccaggagatcgagaccatcctggctaacacggtaaaaccccatctctactaaaaatacaaaaaattagccagggcgccttggcaggcgcctgtagtcccagctacaggctgaggcaggagaatgacgtgaatccgtgaggcagagcttgcagtgagctgagatcgcgccactgcactccagcctgggtgacagagcaaaactccgtctaaaaaaaaaaaaaaaaaaaaaaaaact

SEQ ID NO: 13716 - DNA, 101 bp, Homo sapiens
gggagcagagcttgcagtgagcagagatcacgccactgcactccagcctgggtgacagagcaagactctgtctcaaaaaaaaaaaaaaaaaaaaaaaagaa

SEQ ID NO: 13717 - DNA, 162 bp, Homo sapiens; identical to SEQ ID NO: 6214

SEQ ID NO: 13718 - DNA, 153 bp, Homo sapiens; identical to SEQ ID NO: 6795

SEQ ID NO: 13719 - DNA, 142 bp, Homo sapiens; identical to SEQ ID NO: 7400

SEQ ID NO: 13720 - DNA, 110 bp, Homo sapiens
agatggagtctcgctctgtcaccaggctggagtgcagtggcccgatctcggctcaccgcaatctctgcctcccgggttcaagtgatcctcctgcctcagcctcctgagta

SEQ ID NO: 13721 - DNA, 368 bp, Homo sapiens; identical to SEQ ID NO: 6222

SEQ ID NO: 13722 - DNA, 4704 bp, Homo sapiens; identical to SEQ ID NO: 7404

SEQ ID NO: 13723 - DNA, 2295 bp, Homo sapiens; identical to SEQ ID NO: 6446

SEQ ID NO: 13724 - DNA, 2299 bp, Homo sapiens
gcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgaggacagtagccagggccgagggcgcgggacgcttacgctgacgccacagcctggccttggatctgggacaggcagcgcagggatcaggctgctggctgtggtggggttggcagcgagcctgaaactgctgtccttgggacccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccaaacaagtcacctccgtctgattaagatagttgtttatggtgacgccctattgggggatggatcctggatatttaaatgagctccagtcagtgaggtcaggatctctgggactcagtgctgcaccgcgtgtacaaagacaaagagatgaatctggggtagatttaggtgctaggaatattgtttcttgagttcttgacaggtgcagcttcggggctgcattccttctgtctcctaattttcatctctttatcaggtgatagtagaaaaggctcccaaagctcggataggagacctggacaaaaagaaatacctggtgccttctgatctcacaggtgggaacctgatccaagactcaggcttgcttcctgtgggtgggagtgcagtctctgcgggaggaggctccacctagcagctgttcttttgagggcatttttgacctctgtgactttcttgcatcttgtatcttttgcagttggtcagttctacttcttgatccggaagcgaattcatctccgagctgaggatgccttgtttttctttgtcaacaatgtcattccacccaccagtgccacaatgggtcagctgtaccaggtatggtgactgggaagtggtggaggctttggagaggaatcttggaagagcgtgaggggaagaaagtgttgttacatcagtagttttggactagcttcctggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcaacttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctca

SEQ ID NO: 13725 - DNA, 4682 bp, Homo sapiens
gccgctccccgggggaggggagcggcttggtgcgcctgcgccagcctgtggctttctgggaatcaaagttccggaggttcatgcggtcccttttccgctgttcccggacggactacaaaacccttggtgcactgcgcctcggcgccggcggggggaggagggagagaagaggagggagggaggagagaggaggaggaggaggaggaggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaaggtgagctctcgaccggtgcagagcgctgagccggcggggggcgggcgaggaatcaattggcaaacttggaggtcgagccccggagcccagcgggggagttcggggagggggtcgggaggctggccctggaggtgggagagcgacgagttgagagaccttggagaaagaggagtgggaaactgggctggggtagttggagatcagacggtgtgggggtgcgggggataggagcttgaaacccggagcctcgggggttagggcccgaaagggccaccggcagattggggccctggaactggaaggttaggggaatccagtggccggagagttgctcaggagggaggacgtagaagaggctgagtgaggggcccggtagttcgccgaggtggggtagtttgtggcggtggtaccggagctccgagtagttgccgccggagaatgcccggtgattgtcggagaggtgggcaggtagttgtggggagaagagggggtctgggtattgtctacggcagacggacctgtaccggggggtagttgtggagagagcgagccaggaagcgaggcgagctgggtagttgtagggggtggtggggcggggtggggggggttaagaccggcgacttgtcgggcgggggggtagggttggtccgcgagggttaagagcctgggagttgctgagggtgaggggggcatcggcggcagcagcggtggctgctgtggagagagagagagagtggctggttggggggaaggggccagagttgaggggtccatagcctagtaactgggtggtgagtacgggggcggaggggggggcggcggccggagagggctaggaacagggccggggggcccggtggggagcccgaaaagctggagacggggaggggccaaagccccggatgggggcggagggacggcgaaattgtggggagcgcggtatgggcgggtgggggggcaggtgggggccgcgtccgggttagagctcccgggtctgtcccggccgtgaagtagcgttggatgcgtgtgcctgtgtgtgtctggggtgggggtgaggggcgcgccgggccgcgtgctcgagtagaaggggccggagggcggggagcggttcggcgtggtcatcctggaccctgggggctggcgggcggcgtgtgcggtctcggagggcccgaggcggtggagcgcggccgggtaggaactcggggctccgggcgcgtgtgaaggacgggggcggctggcggcggcccggacgcggccccgggagcggtacggtggggtggggcgctgagggatccgagtagactggagtcgagagagaccgtgagttgggggggcggggcgccgggcctccggttgggggaaggggagcgctatagcgaggcctcagagggcgccgcgcccaggctccgcccctcgcggggcggaagggggagccggggcggatccaacacagctgggggcctgctggcctggcagagggacctgggagagcagggggttcacttaggaacaacggggtttagagggggagttttacacagattgttcctagtgtcttgactcagcttttattgcttttccagatccacctccgacccttaagccagagactcaggtgaggtttgccttacctttgcagcctagtagccctgcctgacaacgccccccgccccccttttctagacctcacttagggactgtgtttctgggaatgccattcttaaactgtgtggctttgcatgtgatccatatctccttcctttcagccaccagagaaacggcggagaacaattgaggatttcaacaaattctgcagttttgttttggcatatgctggttacattccccctagcaaagaggtaggggcaagagaattactgacttgaggctggtgtggtgggactatagagtgactgttgttcaaacagaactgtattgctttatagaaggaggcccctagaaattatatgtaagaccagggaagttggagactcttagggctgtggtaggaaagctggtatgcggggagtggatggccgggatagctagcttgaacagcagtgaaaaggaagggggatttggagtcgctggttgagattttggcatagtcttgaggtgctgtgaatggaaggtgtttatggataaattttagggagatgaaaatggtaacaaatgaggctatacagaaaaagagctaaggacataacggctccggtctgggtgatacagtgttccacaggccctgggcaggggcagcggtgaggtgtcagacttgagggtagaggtaacacggactggtcaagaggacatgctgatgggaattggggtggggagaagtttttggagtacagtgggatttagtggttgaggtaggacattttggggtaaatccagtcactccttttcaagctgggtttgtggaggggctgagatgacactggggttctgctgaccctggtctcttcccccttttaaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggtttgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttata

SEQ ID NO: 13726 - DNA, 8056 bp, Homo sapiens; identical to SEQ ID NO: 6443

SEQ ID NO: 13727 - DNA, 554 bp, Homo sapiens
ggagagttagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaag

SEQ ID NO: 13728 - DNA, 2454 bp, Homo sapiens
gattgcaacccccactttttttttttttgctttccatttgcttggtaaatattcacccatccctttattttcagcctatatgtgtctttacacatgagatggatctcctgaattcatcacatgaatgggtcttaactctatccaatttgccagtctgtgccttttaattggagcatttaacccatttaaatttaggattaatattgttatgtgtgaattttatcctgtcattatgatgctagcttgttattttgctcattagttgatgcagattcttcatagtgttgatggtctttaacttttggtttgtttttgcagtggctggtaccagtttttccttttgatatttagtgcttccttcaggagctcttgtaaggcaagcctggtggtgataaaatctctcagcatctgcttgtctgtaaaggattttatttctactttgcttatgatgcttagtttggctggatatgaaattctgggttgaaaattcttttctttaagaatgttaagtattggctgctactctcttctggcttgtagggtttctacagagagatctgctgttagtctgatgggcttccctttgtgggtaacctgacctttctcttgggctgctcttaacattttttctttcatttcaaccttggtgaatctgatgattatctgtcttggggttgttcttcttgaggagtatcttagtggtcttctctgtatttcctgaatttgaatgttggcctgtcttgctaggttagggaagttctcctggataatatcttgaagtgtgttttccaacttggttccattctccccatcgctttcgggtacagcaatcaaatgtaggtttggtcttttcacatagtcctgtatttcttggaggctttgtttgttctttttcattcttttttctctgatcttttcttcatgctttatttcattaagttgatcgtcagtctctgatatcctttcttccacttgatctattcggctattgatacttgtgtatgcttcacgaagttctcctgctgtttttcagctcaatcaggtcatttatgttctttaaactggttattctagttagcaattcctctaacctttttttcaaagctcttagcttccttgcattgggttagaacatgctcctgtagcttggaggagtttgttattacccgccttctgaagtctccttctgtcaatttgtcaaactgattccccatccacttttgttcccttgctggtgaggcgttgtgatcctttggaggagaagaggtattctggtttttggcattttcagcctttttgtgctggtttttcctcatcttcgtggatttatctaccttttggtctttgctgttggtgacctttggatggagtttttgcatgatgttggtgttgatgctattgctttcagtttattagtttttcttctaacagtcaggcccctctgctgcaggtctgctggagtttgctgcgggtccactccagaccctgtgtccttgagtatcaccagtggaggctgcagaacagcaaagactgactagaaaaaaatcaccgtgagactagtgttaagcatgagaactagtattaaatgaaagttataaagaatagtgtgtaatgactatatgttttggcaaagaaatataattcagctgtaaaaaacagtgggaagagcatatgcaaaaaattttaaaaactattttctgccatcatacttttgactgtagtgtttgttttgttgctcaggtattttctgtgtattgtgcagcagagcaaatgaataattatacattattctaattttgttatctcctgtgtccttgagagctaggaatcttaatgtggaagaaattatatactgtttatatttatatagatgtaagaaggctaaatcctctacttctgatttttaattagaagtatcagtatgaacttgagattctttaatgtcatttaaaaatagtatataccttatatttgtgtgtatatatatatttgtgcatatgtatatgtatgttaatctgagaatgttttatgtgtattgtggcataaatcaaatgaatatttatgtgatattttaatgctggcatttccttgctatgtctatggaaaagtcccagaaatgaacaaacctagttctgtgaatgtggtcttgaaatgctgttttctgcctgggtgcagtggtccattcctataatcccagcactttgggaggccaaggcaggtggatcacatgaggtcaggagttcgagatcagcctggccaacatggtgaaaccccatctctactaaaaatactaaaattagtcaggcatggtggcagacacatgtaatcccagctactcaggtggctgaggcaggagaatcgcttgaaccctggagggggaggttgcagtaagccaaggttgtgccattgtactctagcctgggcgacaaaagcgaaaccgtctcaaaaaaagaa

SEQ ID NO: 13729 - DNA, 109 bp, Homo sapiens
gtttttttttttttttttttttttttgagatggagtttcgctcttgttgcccaggctggagtgcaatatcacaatctcggctcatcgcaacctccgcctcccgggttca

SEQ ID NO: 13730 - DNA, 311 bp, Homo sapiens
tgagaagaatgtatattctgttgatttggggtggagagttctgtagatgtctattaggtctgcttggtccagagctgagttcaagtcctgaatatccttgttaattttctgtttcgttgatctgactaatattgacattggggtgttaatgtctcccactgttactgtctgggagtctaaatctctttgtagatctctaagaacttggttatgaatctgggtggtcctgtattgcgtgcatatatatttaggatagttagctcttcttgttgcattgatccctttaccattatgtaatgggcttctttgtc

SEQ ID NO: 13731 - DNA, 311 bp, Homo sapiens
ggtggagaggacgggcaggtgttcacgtgcccagttaagagtgagatgggtttttatcttcgagtgctacgcctcgtttatgtatttcaggagttgctggggcactgtgggtcagcggctccgggcacctcctgtgcttgaggcagacaccgtctccccgacctcgcttcaccccgtgggtgaaaatgctctgggagctgagaaaaactagtttgtgatcttacagactttcagggctgcacagttttgtaaataggtaaaacactttccagtgttacgattttagtaaattcgtgcttttaaatgatgga

SEQ ID NO: 13732 - DNA, 311 bp, Homo sapiens; identical to SEQ ID NO: 13731

SEQ ID NO: 13733 - DNA, 776 bp, Homo sapiens; identical to SEQ ID NO: 7382
  misc_feature (709)..(709): n equals a,t,g, or c
  misc_feature (738)..(738): n equals a,t,g, or c

SEQ ID NO: 13734 - DNA, 878 bp, Homo sapiens; identical to SEQ ID NO: 7383
  misc_feature (741)..(741): n equals a,t,g, or c

SEQ ID NO: 13735 - DNA, 150 bp, Homo sapiens; identical to SEQ ID NO: 7384

SEQ ID NO: 13736 - DNA, 845 bp, Homo sapiens; identical to SEQ ID NO: 7385

SEQ ID NO: 13737 - DNA, 311 bp, Homo sapiens; identical to SEQ ID NO: 13731

SEQ ID NO: 13738 - DNA, 482 bp, Homo sapiens
ccgggctcctgatgccggggtgaccgggcccttgttaggagctccactctgggccccgcgtggagggacaccccgatgcgctgttgccaggcccccgggtctcttcgaggcacaagaataggctgagcgtggaaggttctgagcgcgggagattctgagcgcattgcccttaccagtctctgctgcccagcttgggccacccagcgtctcccagccggccgacttggtttcttcattaattttgcagttcacttttattgagcactccatactgttgaatccagcttttatagaaacaaccagtttcccttccccctccgttttcattggctcatgtatttaactgaattataaaattgtggtcacaagcgaggttgccgtgaccaggttggtgacccagccctgcctctcggcctgtacggcgcagtccatggagcgtggggggctggaggggaacacattgatatagttttgtgtttctc

SEQ ID NO: 13739 - DNA, 482 bp, Homo sapiens; identical to SEQ ID NO: 13738

SEQ ID NO: 13740 - DNA, 482 bp, Homo sapiens
ccgggctcctgatgccagggtgaccgggcccttgttaggagctccactctgggccccgcgtggagggacaccccgatgcgctgttgccaggcccccgggtctcttcgaggcacaagaataggctgagcgtggaaggttctgagcgcgggagattctgagcgcattgcccttaccagtctctgctgcccagcttgggccacccagcgtctcccagccggccgacttggtttcttcattaattttgcagttcacttttattgagcactccatactgttgaatccagcttttatagaaacaaccagtttcccttccccctccgttttcattggctcatgtatttaactgaattataaaattgtggtcacaagcgaggttgccgtgaccaggttggtgacccagccctgcctctcggcctgtacggcgcagtccatggagcgtggggggctggaggggaacacattgatatagttttgtgtttctc

SEQ ID NO: 13741 - DNA, 1395 bp, Homo sapiens
tgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacggcagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctcaaaaaaaaaaaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaagttatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttctttaaaaaaaaaaaaaaaa

SEQ ID NO: 13742 - DNA, 486 bp, Homo sapiens
cgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaag

SEQ ID NO: 13743 - DNA, 241 bp, Homo sapiens
cagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttttggagacggagttttgctcttgttgcccatgtggctgtat

SEQ ID NO: 13744 - DNA, 13751 bp, Homo sapiens
aagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataataaaattaaaaaaaaaagaaatatagatgttggctatctcaagaaagctggtaattttttgtttttgagattaattagcctagagcacagaagggtgagagaagataggacattcattcatgataaatcatctctccatttgtaaaagtaaaacattttagctgtgggaaaagttgaggagtttaaagttttttatatgagggattgatgaactttttctcttggttcttcatagaaggcttgagttttacttgtttggtgtggtaaatcccaactggagggaactacttggtaattcatatgattcttttatcatggaaatcaagaataaaagcacatactggggaggaagtattcctattagcttgattccttgtttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatttcctttcccctcttttttatgataaatgtaagatcatggtcgttgcctacccagcgtgattttttttctcaagaagttgaatataaagaacttaattatacttcactattaaaataggtaattttggttggtagtttacttttttaaacaatgttaccactacctaaattttgttttgttttcttttttttgagacagggtcttaccgtgtcacccaggctgaagtacagtggtgtgatcatgactcactgcagcgtcagcctcctggctcgagcaattctcccacctcaacctcctgagtagacgggcacatgccaccatgtctgcctaatttttaaattttttacagagacaaggtcctactacgttgcctaggctggtctcaaaactcctgggcccaagcaatcctcccaaagtgctgggattacaggcataagccactgtgcccagccaacctgaaatatgttttaaaacttcatgttggggatttatcttcagaggcagttagcaaacctctgataaagcagatcctagtcaaaaattgtattatccagattgccccacatttcccccagaagtggcaccaggtgatccttgactcctttcagtaatcagattaatcatcccagtatgaatttttcactattaaggcagttcagaagaataatattccataggttctagagacagttcccaggggaattccaaagagatttgaaaatgatagcaacattattacaaatatctggcctcccaagagaactaccttgatggtaattcatttgtttggttatatttgtttaataaaacaaggtcttatttttgtcatgtcagttttatttataatgtagggactaccattataaatgtcttctgttgctgggcatcgtggctcatgcctgtaatcccaacactttgagaggccaaggcgggcgaatcacttgagcccaagagttcaaggccagcctgagcaacttggagaaatctgtcactactaaaaatacaaaaattagctgggcatggtggcgcatgcctgtagtcccagatagttgggaggctgaggcacaagaatcacttgaatccagggggcggaagtcacagtgagccgagatctgctactgcactccagcctgggcgatagagcaagactctgtctcaaaataaataaattaattagataaaataaaaaataaattagctgggtgtagtggcacacacctataatcccagctactgaggaagctgagatgggaggattgcttgagcctgggatgttgaggctgcagtgagctgagatcatgccactgtactctagcctgggtgacagagtgagaccctgtctcaaaaaaaaaagtcttctgtatcctagactgcatatatccttcatctctaaatctcatgataattctaaaacatcagtattatcccaattttaaaggtaaggatactaagacttggggaaggaagttatttgttacaatcatactgattaaaggccaagatttaaatctaggattatctctactctaaagtccatatactttgtactatattttcctgcctttcctgttcatgaaatttatctattttttaactcttctttaatggaatgcttcatgaatttgcctgtcatccttgtgctagggccatgctaacctctgtatcgttctaattttagtatatgtgctgccgaagcgagcactgttcatgaaatttatttttattttatttattttatttttattttttgatacagggtctcactctgttgcccaggctggagtgcagtggcacgatcttgcctcactatagcctctgcctcccaggttcaagtgattctcctgcctcagccacacaagtagctgggattacgggcctgcaccactacatccagctaatttttttttggtttttgtgggttttttttgtttttttttttttttgagacagagtcttgctgtgtcacacaggctggagcacagtggcacgatctcggctcactgcaaccctgcaacctctgcttcctgggttcaagccattctcatgcctcagcctcctgagtagcaggactacaggcatgtaccaccatgcccagctaatttttgtatttttggtagagacatggggtttcaccatgttggccaggctcatctcgaactcctgacctcaagtgatctgcccacctcagcctcccaaagtgctgggattacaggtgtgagccaccacgcctagccttaatttttgtatttttagtagaaatggggtctcccattgttccttgttggccaggctggtttcaaactccaggtctcaagcaatccacctgcctcggcctcccagagtgctggtattaaaggtgtgagccatcgtgcccagccttgtttatgaaatttaaatggcacagtatacacaaagctcttatgccagtttttggcaaactataagtgcttattaactatggtacttaatactgtcaaaaacaatataataataagtctatatgcatataggaagtaatcgtagtactatttgacatactctcttatagtaaactatttgggtcacttttcttctcttaataacccttaaaatcagttgaacatggtcaagtccactgggactattcgttgttttttataaagaaataagcactattataacaaagtcttgacaaactaggtatcttattatacatgttgtctttgaacataaagatgagagctagtttatgctctgtatctttttcttttcttcctttctgaggtgtttgcagaattaaccagagagagccttgcttctcttggtatataaacataaggatgaaaatgaaatagctaaattttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatgactatcctcacagatttttaaatcctggtgttggatttgccctggcatgttgtcattatcaacagaagacttattatgtgcctactctatgtggatcatagggctagtcatataaaatgaagaaaggagtatggatgatctagaaggtttgtcctagccctatagttctgagattgcgttatcacagaaatgctctgaggataaactgtgggagaaggtactttttcctgtggccagttaacagagacgattaagcatacaaaagtataaaggccaaagatgtgagatcagttatctttgaagaattccattagcttctgtgtcttctatgatcctgtcttctctccacgaatacaatcaagaatatctggagcagtgcactgggcaactcaaaaaaagcacaatctagagtctgtttctgaccagtgtcaggtataactttgtgcagctgacacacatgtgttttgtaggtaccaagaactaggttcatgttccaattcagtttctttctagctgtataactttgggtaaatcatataaattatctgaggtttagtggggtcaaaaatgatgcctagagtttctgggaagatgaaataccaattataataatagcaaatgtttattgaacatttactgtatgttgggtattctgctaaatgcattatctcattaagttttagaacactcattttatagataagaatacaggcccaaagtttaaatcaactcttccagtatcatatagcccaaaagtggtagagcaggaattccagcccaagtttgaaaccagaattcatactcgtagtcactatcttaaaaacctattatacttaactggtgcataatagccgcacaaattataggtacaattatttatatatgaagttaagtgtagcatctgtgccatacagactgtctcattgccaacttgtagaagcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaacctagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaaacctctgtactctagctaatcacttccctatcctcccacttgcctgagccctgggcaaccaccagtctactttctctgttctcttttatggacatttcatatgaatggaatcatacaatatgtggtcttttataactgggttctttcacttagtgcaattacttcctatgtatactgcacacaaggttcgttcatgttgtagcatgtatcagtacttcattcctttctatggtcaagtaacattccattttgtttatccatttgttgacagacatttgggttgtttctactttttggctattatgaataatgttgctatacatatttgtgtacatgtttttaggtagacatgttttcatttctcttgggtaatacacctgggagaagacttgtatggtatgctaactctctttgtttgatgaactgccagactgttgtccaaagtggctgccctattttacaatctcactagcagtgtacaagggttctgatttttttcacgtttcctgctgatttttaccaactgccgtattgttggtggagtggaatgtgaatgttcttgctctcttcccggctttctgctgatgtcttctccctcccccacctcaccgactgatttagtagcttaacagtggctgattctgatgtcttattcccactgccaggtcatgtgatgtgaaaatggcaatgaaaggtttcacagactactagttgccacgtgcagacaacacaagctatgtgactctctcgcaaaaagtgattttgtcactccccagcaaattcattatacagtctaaactccttcagcatatgaagtattacagcattcatcccctagtgacatctccagctttcttttatgcccctctcaaaatacattctcttactctggcaatattatggaatttgcaatatgctaagttatccaagtttccagtgaccccgtacctttaaacatattcttctctctggcttagctatctttctgtaacctggctcactcctacttccaagaagccttccctgacataccttagtcttccttaacatgccttagtctaaattaggtggtcctagttattctttttttttttgagatggagtttcactcttgtcacccaggctggagcgcaatgacgcgatcttggctcactgcaacctcctcatccggcttcaagtgattctcctgcctcagcctcctgagtagctgggattacggacccacgaccacacccggctaatttttgtattttttgtagagatggggtttcaccatgttggccaggctggacttgaactcgtgacctcaagtgatcgcctagccttggcctcccaaagtggtgggattacaggtgtgagccaccacgcccagcccatcctagttattttctttcaggcaatttatgctttacacttctggtgaggttaccaacatgggagcctatagattgagttttataatactggtgtcctccctccctggggccccgcccctcctgcttccataagtgttgagcgtccgttatccagttcactatgtcacgttgtatctcttatgccccggttgggatcttttctcacgtcacccccgtgggtaagccagacccacgcctcacgggcctggcgtggcatgttttgttatgtgaatgattgacattcatctgggctgggctgcagccttgacctcctaattagtctttgcctgcagcccagtcattgtcagccatccacaaagtcccctataacctagccatctctatgaacattcccttctcttttttttttttttaaacaacaaattggatccactgaaacttttatttaactttgtaatatgaacatttaccatataaggttataagacaatataaaatctatctcatttcatttatagcatagctataaatcaatctaatctctcttattaatgttttaaaaaaaaaaatatatttttttttttcctgcatacttaggcaatattttccccaagggatatatcattctcagtaaactaccgcaagaacaaaaaaccaaacatcgcatattctcactcataggtgggaattgaacaatgagatcacatggacacaggaaggggaacatcccttctctttcttaccctaagtgaaacctgaccataacctctgaggacatatttccactgcagactgcaagtggtggctgatgtttctctcacagccttcattactccggtactacaggtagagatgggtctctcctttgcagcttccaatgcgtcctcttccctaaaatcccccctttgaatgcatgtcatcacattgtgccacttctatgcctcttctttgcggttaaacacacacctagtcttttgaagataattcctggctcattggcactctctctaacatttgtcctttcttaagtcttggtgattgccatattcacatagatggttattctagtaacttggcctctcagttttacttcctttcttcccattatcctgttttctatcatgccttaaacatttattttcatagacataccctagtagaccttgcaattaataagaacaaattacctgcaataatttcagttttaagtatcccaccctgaccattgcttcctgttactctcatttatttccttctagttctcttgtcacggcatttcttctgccccagtggcatctgtaacccacttcacttcctccttacctggcttagattccatgacacttctgtagtccagttactctctccctgtcctggaggatctttcatatcttccctgtcctcaaacctgctaggcctcctcccccatctttactctcggttttttgttgttgggaagatagaagccatcataagtctaccatcactactcacctacttccaagtacctatctaaggccttccctcccttgggtctatgggattctatctcttctctcttacttgatgttttcctctctgctggatcattccttctgacatacaaatatactgtaatttctcccaactgaaaaaaaaaaaggttttctttccccttctgcttctcacacagtctcctcatttctctgctctccttttcttcttgtgctatcacctggatctgctcttgtctcctttacttgacctgtcagcagcatttgacatagctaattacccttactttgtaatactttttttttttaactaggcttctcagataccacacacttctaattttcttcttaccttaatgtttgttcctcagtctcctttgtgattcttcatctcccatttttttacatttgaaatgccaccagggcttgttctggaacctcttctctatgatgaagatctctaaatttgtattttcatccttgacctcttctctgaactctaaatatattctggcattctttttgatgttggatcctaataggcatctcaaagtcaacaggtccaaaacctaactcatctctcactcatccaaacctgcccttccctcagtttttcccacttcaataaatggcagtgctgtccttacagagctctggagtcatttggactcctctttctcagtccttctttagtctgtcagcaaatcctgttagctccaccatctaaatgtattgtccaaccatttaccatctccacagctaccatcctctctcacatatgttactgtaatgatgttcttttatggtttggtttttttgagacagagtctcacactttcatctaggctggagtgcagtggcgcgatctcggctcgctgcaagctccgcctcctgggttcacaccattctcctgcctcagcctcccaaatagctgggactacaggcaccagccaccacgtctggctaattttttgtatttttagtagagacggggtttcaccatgttagccaggatggtctggatctcctgacctcgtgatctgcccgccttggcctcccaaagtgctgggattataggtatgagccacggcacccggcccactgtaatgatgttgtaatggacttctgcagccctctctccacccatagtctattcccaggacagcaagcaaagtgatccttttgaaacataagtcagatcaactcagtcttttgctcaaaactctctcagagaaattgccaaaatcctaaggatggcttagaagtccatacatgtctattctctgcactccacacaccgatgcaaacataccctcatctccttggctctcatcctctcccacttcattctgttcacattaggcccctttctgttcttaagacatttcagggatgttcttgcctcagggcctttgcacttgctgttcctttttcctggaacattctttttccagatagcttattctcttacctttcttgtctctgctcagacatctgcttagtgaaggcttttctgcccatctatttaagagaacatcttctttttttatactgtctgttccctcacacacactaaaatgaaagtcccaaaaggcagacatttatattatgttcactgccgtatatccttaccatctaaaactgcctgtcacatataggtaggctcagtaaatatctgaattaatgaacatttctaaaatgtatcaggtcacaactcatcagatcatggactgccaccaaagccatgtaactgccaataaaactgggcacagaagtctaaaaattactgtgatatcaattagcagttggtcagaacttgagaaaatattttgaggtgttgaaaatagttaaaggaacttcactactagctctccaagttgggagttactgcctagaccaacaattattgaggagctgtgaccttttgagcactagttaatgatagacactgttttagtcatgacagtaatcctgaaagcaggtggaagttctcccattttaaacatgcagaaatagagcctcaagaaactgcttcatttaaagataatactagcttgacaatccactgaatatgtcctaataaatggaaacagggtgggggatgtcagcctaccagtaattggtgtcattaaaccctcttgaatgaatggacatagtaatggccttcagggtaccttgaagtatagctaaaggaatctctggagttcatttagtaaagcagttggcatccctggcctgggatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcaccagaaacaaagggaaaagaaacctcccagtctagtgaagaaagtagtacacatcatgtcaacagataggtaattttgttgataccataagagcctattattaggcctggcatatgacaggaggtcagtatttgagttgagtattgattgatggtactgtggaagacagaggaaacacatctgacccagattggtaggctttcccagaaaagtttatgcccaagtatagtgttaacaaataagaacttctcaggtgagataggggagaagagtctgcgaggaaaacctgtctagcatggcaaatacgaagtccagagatgagagaagatggtccacgtggtttaaaagtctacaacaaggtaaaggaggtacacagtaattaaagtaggaaagatatgtcaacacctaagaatcagaactagtatcttgaaaagttaggagccctggggttttgtttttgcttttgcttttaaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtcctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttcctacacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagcctta

SEQ ID NO: 13745 - DNA, 5204 bp, Homo sapiens
aagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataatcaaattaaaaaaaaaagaaatatagatgttggctatctcaagaaagctggtaattttttgtttttgagattaattagcctagagcacagaaggttgagagaagataggacattcattcatgataaatcatctctccatttgtaaaagtaaaacattttagctgtgggaaaagttgaggagtttaaagttttttatatgagggattgatgaactttttctcttggttctttatagaaggcttgagttttacttgtttggtgtggtaaaatcccaactggagggaactacttggtaattcatatgattcttttatcatggaaatcaagaataaaagcacatactggggaggaagtattcctattagcttgattccttctttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatttcctttcccctcttttttatgataaatgtaagatcatggtcgttgcctacccagcgtgattttttttctcaagaagttgaatataaagaacttaattatacttcactattaaaataggtaattttggttggtagtttacttttttaaacaatgttaccactacctaaattttgttttgttttcgttttttttgagacagggtcttaccgtgtcacccaggctgaagtacagtggtgtgatcatgactcactgcagcgtcagcctcctggctcgagcaattctcccacctcaacctcctgagtagacgggcacatgccaccatgtctgcctaatttttaaattttttacagagacaaggtcctactacgttgcctaggctggtctcaaaactcctgggcccaagcaatcctcccaaagtgctgggattacaggcataagccactgtgcccagccaacctgaaatatgttttaaaacttcatgttggggatttatcttcagaggcagttagcaaacctctgataaagcagatcctagtcaaaaattgtattatccagattgccccacatagcccccagaagtggcaccaggtgatccttgactcctttcagtaatcagattaatcatcccagtatgaatttttcactattaaggcagttcagaagaataatattccataggttctagagacagttcccaggggaattccaaagagatttgaaaatgatagcaacattattacaaatatctggcctcccaagagaactaccttgatggtaattcatttgtttggttatatttgtttaataaaacaaggtcttatttttgtcatgtcagttttatttataatagtagggactaccattataaatgtcttctgttgctgggcatcgtggctcatgcctgtaatcccaacactttgagaggccaaggcgggcgaatcgcttgagcccaagagttcaaggccagcctgagcaacttggagaaatctgtcactactaaaaatacaaaaattagctgggcatggtggcgcatgcctgtagtcccagatagttgggaggctgaggcacaagaatcacttgaatccagggggcggaagtcacagtgagccgagatctgctactgcactccagcctgggcgatagagcaagactctgtctcaaaataaataaattaattagataaaataaaaaataaattagctgggtgtagtggcacacacctataatcccagctactgaggaagctgagatgggaggattgcttgagcctgggatgttgaggctgcagtgagctgagatcatgccactgtactctagcctgggtgacagagtgagaccctgtctcaaaaaaaaaagtcttctgtatcctagactgcatatatccttcatctctaaatctcatgataattctaaaacatcagtattatcccaattttaaaggtaaggatactaagacttggggaaggaagttatttgttacaatcatactgattaaaggccaagatttaaatctaggattatctctactctaaagtccatatactttgtactatattttcctgcctttcctgttcatgaaatttatctattttttaactcttctttaatggaatgcttcatgaatttgcctgtcatccttgtgctagggccatgctaacctctgtatcgttctaattttagtatatgtactgccgaagcgagcactgttcatgaaatttatttttattttatttattttatttttattttttgatacagggtctcactctgttgcccaggctggagtgcagtggcacgatcttgcctcactatagcctctgcctcccaggttcaagtgattctcctgcctcagccacacaagtagctgggattacgggcctgcaccactacatccagctaatttttttttggtttttgtgggttttttttgtttttttttttttttgagacagagtcttgctgtgtcacacaggctggagcacagtggcatgatctcggctcactgcaaccctgcaacctctgcttcctgggttcaagccattctcatgcctcagcctcctgagtagcaggactacaggcatgtaccaccatgcccagctaatttttgtatttttggtagagacatggggtttcaccatgttggccaggctcatctcgaactcctgacctcaagtgatctgcccacctcagcctcccaaagtgctgggattacaggtgtgagccaccacgcctagccttaatttttgtatttttagtagaaatggggtctcccattgttccttgttggccaggctggtttcaaactccaggtctcaagcaatccacctgcctcggcctcccagagtgctggtattaaaggtgtgagccatcgtgcccagccttgtttatgaaatttaaatggcacagtatacacaaagctcttatgccagtttttggcaaactataagtgcttattaactatggtacttaatactgtcaaaaacaatataataataagtctatatgcatataggaagtaatcgtagtactatttgacatactctcttatagtaaactatttgggtcacttttcttctcttaataacccttaaaatcagttgaacatggtcaagtccactgggactattcgttgttttttataaagaaataagcactattataacaaagtcttgacaaactaggtatcttattatacatgttgtctttgaacataaagatgagagctagtttatgctctgtatctttttcttttcttcctttctgaggtgtttgcagaattaaccagagagagccttgcttctcttggtatataaacataaggatgaaaatgaaatagctaaattttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatga

SEQ ID NO: 13746 - DNA, 372 bp, Homo sapiens
aagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagact

SEQ ID NO: 13747 - DNA, 345 bp, Homo sapiens
gcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaactagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaa

SEQ ID NO: 13748 - DNA, 495 bp, Homo sapiens
tgtctctctgtgatggagaacaaaggacatagaattaaggaattaaccttagagaatgtttacattttaaagagtggagaagaatcaaagagtagtcaaatatgatagaaaatcctgggcgactatttctgagttttgttttgttttgtttttttgccctttaagtagctctctttagtaggaaagggaagaatattgacttgggttagttagttctgatttcaaatttcccctttatcacttacttggcagtatttaaccttttcagagtgtttcactgtcagaaaataggaattcagggttgtgaagattacataaaataaatacataaagcacagtgcttgtgacagagtttctttaacttcattagcaccttccctgtgacttcaagtatagacaggacttttatacattagaatggaatatttgtttaactttgtttatgtctcttgttttctccttccttttgcttccacttaaaaaaaaaaaaacaaa

SEQ ID NO: 13749 - DNA, 746 bp, Homo sapiens
ttgttgccacagggaggtagaagatcgacatgaaaaactggggatctgaaaacgagcccctatcctaggattacctgaaggtgaaacagattgagccagaaggaagacaatgctggtaggttggtttttaatttattaagaatgtttgtaattttatatttcattaaaattatttcatctacctttaccatatttttgtttaaagggtgacaatgattcctccttaaggaaggagaagtaatacgataatatttttcctccaagatagtttgctgaattatcccttgccatattcttaatatttgtttctttttatagataaagctctggggctatttcatgcctctacttccttggaagctactattgactgaacgtctttaagtcattttttttttttgtcatttctgttggttttgcttctaatctacatcttttcctaaatttttaataagtgtttttttcccccaattatttattttcttgaggttagcctagccctaagttttctaaaatggtaaaatgtgaatcttaagttcatttagcttttactctagaattgtttgaattgtaattgtactgtgatttagatcagacagtattattagataaaagattttaatactttaataactatcagccaggtatagtggctcaagcctgtaatcccagcactttgggaagccgaggtcaggagttcaagaccagcctggccaacttggcaaaaccccatctgtactaaaaaa

SEQ ID NO: 13750 - DNA, 303 bp, Homo sapiens
aaccccatctctactaaaaatacaaaaattagctgggtgtggtggtgcacgcctgtaatcccagctactcaggaggctgaggcaagagaattgcctgaaccgggaggtggaggttgcagtgagctgagatcatgccactgcactccagcctgggcaacagaaactccatctcaaaaacaaacaatcagataaacaaaaaagatgcacaaatgtgtagtcaagatcccatcacaaaagagatggcatgctaaaattaggataatttaaggaatgttttaataaagggctagttacaaacatgta

SEQ ID NO: 13751 - DNA, 1647 bp, Homo sapiens
cacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaa

SEQ ID NO: 13752 - DNA, 1647 bp, Homo sapiens; identical to SEQ ID NO: 13751

SEQ ID NO: 13753 - DNA, 1647 bp, Homo sapiens; identical to SEQ ID NO: 13751

SEQ ID NO: 13754 - DNA, 1647 bp, Homo sapiens; identical to SEQ ID NO: 13751

SEQ ID NO: 13755 - DNA, 361 bp, Homo sapiens
gctgtgtgttcatggtgtgcctgctgcttagaaccctgtgccctctttgttcaaggggtaaaactggattggaggtaaacctcagtctctttctgtacattgaaggaagagatcaatgatcttcaaaccaatcattacagatttccccagttgaatttgacttagcttttggatgttgagactgataaggtgattgaaaacctggccttaaccacagccaatgatattgagagttcaaggagaaacacacagccttttcaagggtttagaatccgattgggattgggaggaggtgtgtatccacgctacctcatggaagagtgtttctagtttaaaggagacagaaaagaaaaaaaagaaa

SEQ ID NO: 13756 - DNA, 496 bp, Homo sapiens
gggaagaccaatgtaaatccaagagcacaaatgaatggaaagtactctctgacagaggtcatcagggggtatcctcaatgagagcctgaaactctggatgtgacggagtcagagagattggggacagcttccctgagcaagtggtgctagaacctgggtctgcggtatgcataggagttaacaaagcaaggtgggtgggtattgaaagaacgttccagttgtaggattagtaccaaaaggcccctgccactattatttatgtcttctttgtgatgacttttcaggatctacatagactgttggcctttgctatcatgcaatgtatgttacctagtttcactatttctttttgagggaggataggttttttatctttttaaattaaagaacatatctatcttcagaaacaatgtattttaattaaatgattcatattttccgagaatatttttcgtatagatgttcggcacaatgtagatttgagagaccagtaaca

SEQ ID NO: 13757 - DNA, 316 bp, Homo sapiens; identical to SEQ ID NO: 7788

SEQ ID NO: 13758 - DNA, 235 bp, Homo sapiens
tggcgccatctctgcccactgtaagctccgcctcccgggttcacaccattctcctgcctcagcctcccaagtagctgggactacaggcgcctgccaccacgcccagctaattttttgtatttttagtagagacagggtttcatcatgttagccagggtggtctcgatctcctgacctcgtgatctgcctgccttggcctcccaaagtgctgggattacaggcgtgagccaccatg

SEQ ID NO: 13759 - DNA, 149 bp, Homo sapiens
gggactacaggcacccgccaccacacccggctaattgttgtatttttagtagagacggggtttcaccatgttagccaggatggtctcaatctcctgacctagtgatctgcccaccttggcctcccaaagtgctgggattacaggcgtga

SEQ ID NO: 13760 - DNA, 228 bp, Homo sapiens
ctgcaacctccacctcctggttcaagcgattctcctgcctcagcctcccacgtagctggattacaggcacgtgccaccacgcccagctaatttttgtatttttagtagagatggagtttcaccatgttggccaggatggtctcgatctcttgacctcgtgatctgcctgccttggcctcccaaagtgctgggattacaggcgtgagccactacgcccggcctgcctat

SEQ ID NO: 13761 - DNA, 259 bp, Homo sapiens; identical to SEQ ID NO: 12223

SEQ ID NO: 13762 - DNA, 319 bp, Homo sapiens
tagatttctattctttttctttttgagacggagtctcgctctgtcgcccaggctggagtgcagtggcgccatctcggctcactgcaagctccgcctcccgggttcacgccattctcctgcctcagcctcccaagtagctgggacggcaggtgcccgccaccatgcccggctaactttttgtatgtttagtacagacggggtttcaccatgttagccaggatggtctcgatctcctgaccttgtgatccgccggcctcggcctcccaaagtgctgggattacaggcgtgagccaccgcgcccggcctgatttctattctt

SEQ ID NO: 13763 - DNA, 300 bp, Homo sapiens
gtgtggtttttttttttttttttttgagacggagtctcgctctgtcacccaggctggagtgcagtggttccatctcggctcgctgcatgctccgcctcctgggctcatgccattctcctgcctcagcctctggagtagctgggactacaggcgcccgccaccatgcccggagaattttttgtatttttagtggagacggggtttcaccgtgttagccaggatggtctcgatctcctgacctcgtgatccacccgcctcggcctcccaaagtgctgggattacaggcgtgagccaccgcgc

SEQ ID NO: 13764 - DNA, 268 bp, Homo sapiens
tttatttattgagacggggtctcgctctgtcccccaggctggagtgcagtggccccatctcagctcactgcaagctccgcctcccagattcatgccattctcctgcctcagcctcctgggtagctgggactacaggcgcctgccaccgcgcccggctaattttttatatttttagtagagacgaggtttcaccatgttagccaggatggtctcgatctcctgacctcgtgatccccctgcctcggcctcccaaagtgctgggattaca

SEQ ID NO: 13765 - DNA, 296 bp, Homo sapiens; identical to SEQ ID NO: 9806

SEQ ID NO: 13766 - DNA, 2548 bp, Homo sapiens
gaattttttttttttttttttttttttttttttttttgagatggagtctcactctgtttcccaggctggagtgcagtggcgcaatctcggctgactgcaagctccgcctcccgggttcatgccattctcctgcctcagcctcccgagtagctgggactacaggcacctgccaccacgcccagctaattttttgtatttttagtagagacggcatttcactgtgttagccaggatggtctggaattcctgacctcatgatctgcccgtctcagcctcccaaagtgctgagattacaggcatcagccaccatgcccggccctaccttaatgaattttgaaatcaaatcttctatactctttgcttgttgaaaatttcccactaggcttgtagctttttctatttgtctttgtagttctatcagttcttacgtcttgtgctttgagactatgttattagagatttagcaatttaggattgttgtatcttctgggtttaagactttttggccgggcgcagtggctctcagctgtaatgccagccctttgggaggcagaggtgggcggattgcctgaggtcaggagtttgagactagcctggccaacatggggaaaccccatctctactaaaactacaaaaattagccaggcaatggtggtacacgcctgtaatcccaggtactcgggaggttgaggcaggggaattgcttgaacctgggaggcagaggttgcagtgagctgagatcatgacactgcactccagcctaggcaacagagtgagactgggtctcaaaaaaaaaaaaaaaaaaagaatttttgccttaaagtaaattttatctaggaattatatagtggtgatggctgcataatattttgaacatactgaaaaaaaattgaattatatactttaaaaggaaggaggaaaccaaccttttattttatatatatatatacacacactatatatatacatatatatacacgtatatatacacacatatatatataaaatacagctatatcagctttcttttagagtcttccaattttatatttctcagtccttttactgtatccttttttccatatccttatgccttacctgtatccttatgccttactgtatccttatgccttacctctgtctctggtaaatagcatgttgtttgttttttaaacctgtctactaattcttgtattttaactggagaatttcttttccatttatattcactgtaactattggtatatttcagtctgaatctataattttattaagttctttctttttttttttttgagacggagtcttgctctgttgcccaggctggagtgcagtggcatgaacttggctcactgcaacctctgcctcccaggttcaagctattctctggcctcagcctcccaaggtagctgggattacaggcgcatgccaccatgcccggctaatttttgtatttttagtagagacggagtttcaccatgttggctaggctggtcttgagctcctgacctcatgatccacctgcctcggccttccaaagtgctggattacaggcgtaagccaccgcgcccagccctaaatgctttgtatttgtctcctcagtcatcctcagtcatcatcagtggctttgacgtgagaagactttgtggaatggtagagaggaaagttatattggaatagggtgggagtgaacagattgagggagcagaaatagcattttgggggcaactgtttctagaagtttcgctatgaaggaaagcagagaaatgaggtggagtatgaaaagaaataataggccaaggaagaattttaagagtgagagataccagagcatgtttgtatgctgaaagagcactctttatgtgctctatattcccttttctctcctttcttgccttcttttgaattgataatatatttttaacttttctacattttttctctaccggcttggaaattatgcaccctttcactattcttttagtaatactacagggattactatatccacccttgacttatttaagtctaataggaatttatcttcttccaggatagtgcaagaaccttggaacacttttactccatttactgtcttggcttttacgtcattgttgttatacgttttaatttcatttccaacctcatgttattattattgctttatgcagccagcatcaattcaggtttataaacatatttaccatcttcattgtttttcattcttttctgcgtttgcaagctttttttttttttgagacggagtctctctctgtcgcccaggctggagtgcaggggcacagtctcggctcactgcaagctccgcctcccgggttcacgccattctcctgcctcagcctcccgagtagctgggactacaggcacccgccactatggccagctaattttttgtatttttagtagagacggggtttcaccgtgttagccaggatggtctcgatctcctgacctcgtgatccgcccgccttggcctcccaaagtgctgggattacaggggtgagccaccgcgcccggccatttgcaagct

SEQ ID NO: 13767 - DNA, 288 bp, Homo sapiens; identical to SEQ ID NO: 12230

SEQ ID NO: 13768 - DNA, 301 bp, Homo sapiens
tcttattctttttttttttttttgagacggagtttcgctctgtcgcccaggctggagtgcagtggcgcgatctcgactcactgcaagctccgcctcccgggttcacgccattctcctgcctcagcctcccgtgtagctggggctacaggtgcatgccaccatgcccggctaatttttgtatttttagtagagacggggtttcaccgtgttagccaggatggtctcgatctcctgacctcgtgatctgcccgtctcggcctcccaaagtgctgggattacaggcgtgagccaccgcgcccgg

SEQ ID NO: 13769 - DNA, 300 bp, Homo sapiens
ttttatttatttatttatttttgagacggagtcttgctctgtcgcccaggctgtagtgcagtggcgcgatctctgctcactgcaagctccgcctcccgggttcacgccattctcctgcctcagcctccggagtagctgggactacaggcgcccgccaccatgcctggctaatttttttttgtatttttagtaagacgggatttcaccgtgttagccaggatggtctcaatctcctgaccttgtgatccgcccgcctcggcctcccaaagtgctgggattacaggcgtgagccaccgcgcc

SEQ ID NO: 13770 - DNA, 120 bp, Homo sapiens
attttttgtattttcttttttagtagagacggggtttcaccgtgttagccaggatggtctcaatctcctgacctcgtgatccacccgccttggcctcccaaagtgctgggattacagggt

SEQ ID NO: 13771 - DNA, 611 bp, Homo sapiens
ttttttttttgagacggagtcttgttctgtcgcccaggctggagtgcagtggcgggatctcagctcactgcaagctccgcctcccgggttcacgtcattctcctgcctcggcctcccgagtagctgggactacaggtgcccgctactacacccggctaatttttttttttgtacttttagtaaagacagggtttcaccgtgttagccaggatggtctccatctcttgacctcgtgatcctcccgcctcagcctcccaaagtgctgggattacaggcgtgagctgccgcgcccagcccacaactgaaattttttttttttttttgagacggagtctcgctctgtcacccagactggagtgcagtggtgggatctcggctcactgcaagctctgcctcccgggttcatgccattctcctgcctcagcctccccagcagctgggactagaggcacccgccaccacgcccggctaatttttgtatttttagtagagacggggtttcactgtgttagccaggatggtctcgatctcctgaccttgtgatccgcccgcctcagcctcccaaagtgctgggattacaggcgtgagccacagcgcccggccaacaactg

SEQ ID NO: 13772 - DNA, 311 bp, Homo sapiens
acttttttttttttttttttttttgagatggagtcttgctctgttgcccaggctggaatgcagtggcgcaatctcggctcactgtaagctctgcctcccgggttcacgccattctcctgcctcagcctcccgagtagctgggactacaggcacccgccaccacgcccagctaattttttgtatttttagtagagacggggtttcaccatgttagccaggatggtctcaatctcctgacctcatgatctgcctgcctgggcctcccaaagtgctgggattacaggcgtgagccaccgcgcctggccttctat

SEQ ID NO: 13773 - DNA, 297 bp, Homo sapiens
tttctttttttttttttttgagacagagtctcgctctgttgcccaggctggagtgcagtggcacaatctcagctcactgcaagctccgcctcccgggttcactccattctcctgcctcagcctgccaagtagctgggacaacaggcacccaccaccacaccctgataatttttttgtatttttagtagagacggggtttcaccgtgttagccaggatggtctcgatctcctgaccttgtgatccgcccgcctcggcctcccaaagtgatgggattacaggcgtgctaccgcgcctag

SEQ ID NO: 13774 - DNA, 148 bp, Homo sapiens
tattttttttttttttttttttgtattttttagtagagacggggtttcaccgtgttagccaggatggtctcgatctcctgacctcgtgatctgcccgccttggcctcccaaagtgctgggattacaggcgtgagccaccgcgcctggc

SEQ ID NO: 13775 - DNA, 310 bp, Homo sapiens; identical to SEQ ID NO: 12247

SEQ ID NO: 13776 - DNA, 1059 bp, Homo sapiens
acggggtttcaccgtgttagccaggatgatctctatctcctgaccttgtgatctgcctgccttggcctcccaaagtgctgggattacaggcgtgagccaccgcgcccggccaagccgcatccttttaaattattcatctgttgaaggatgtttgaggtttttcactttttggcttttgtaagtaatatggtttggatctgtggcgccattcaaatctcacatcaaattgtaagcctgaatgttgtaggtggggcctggtgggaggtgactggattatatggttggattctcatgaatcatttaataccattgcctttggtactctctttgccataatgagtgatttctcctgagatgtcactttctttctttgtttttttgatatctcatccatcgcagtttaatctacaaatgaaatttctacagaaacaggaactattttaagaaagaaaaaaatccctcattcagacttctttggtagtggtaatggctgcaaatttgcagcatttagaaaactacactatcaacaagctttcctttatgaactgagatgtacaaaatgtagaaagcagatgaaagtgaattatttcttcaacattttagtaaaacttctgataatcagagttcaaagcacataacaactcaagcataaatgaagatggagagcctggggagtttgatttcttaaattttccaaaaaggtattattgcaaacatataggatttccccccattttaaccttaccagtttcaaaggaaagtaaaggtactggattacatgaagacagcatgtgtgcgagtgcacacgcatgcagggtggcaggtagagtgtcttaattcctttttcttactacccaagtctcacttcacagaaatcattaggtaaaggaaaaccaacgaggagttctgcagttttcttttaataactgaggctgaggcaggagaatcgcttcaaccctggaggtggaggttgcagtgagccaagattgtgccactgcattccagcctgagcgatagagtgagactccacctcaaaaaaaaaaaaaaagaaaagaaaaa

SEQ ID NO: 13777 - DNA, 310 bp, Homo sapiens
tttttttttttttttttttttttttgagacggagtctcgctctgtcgcccaggctggagtgcagtggcgcgatctcggctcattgcaagctccgcctcccgagttcacgccattctcctgcctcagcctcttgagtagctgggactacaggcgcccaccaccaagcccggctagttttgtttttgtatttttagtagagacggggtttcaccgtgttagccaggatggtctcgatctcctgaccttgtgatctgcccgccttggcctcccaaagtgctgggattgcaggcgtgagccaccgcgcccggct

SEQ ID NO: 13778 - DNA, 312 bp, Homo sapiens
tttttttttttttttttgagacggagtctcgctctgtcccccaggctggagtgcagtggcactatctcggctcactgcaggctccgcctcctgggttcacgccattttcctgcctcagcctcccgagtagctgtgactacaggtgcccgccacctcgcccggctaattttttgtatttttagtagagacggggtttcaccatgttagccaggatggtctcgatctcctgacctcgtgatccgcccgcctcagcctcccaaagtgctgggattacaggcgtgagccaccgcgcccggccaagggcttctgttt

SEQ ID NO: 13779 - DNA, 303 bp, Homo sapiens
ttctttttttttttttttttttttgaggtggagtctcgctctgtcacccaggctggagtgcagtggcacgatcttggctcactgcaagctctgcctcccgggttcccgccattctcctgcctcagcctcccgagtagctgggactacaggcgtgcgccaccacacccggctaattctttgtatttttagtagagaggggtttcaccgtgttagccaggatggtctcgatctcctgaccttgtgatccgcctgcctcagcctcccaaagtgctgggattacaggcgtgagccaccacgcccggc

SEQ ID NO: 13780 - DNA, 295 bp, Homo sapiens; identical to SEQ ID NO: 12265

SEQ ID NO: 13781 - DNA, 320 bp, Homo sapiens; identical to SEQ ID NO: 9822

SEQ ID NO: 13782 - DNA, 322 bp, Homo sapiens; identical to SEQ ID NO: 7795

SEQ ID NO: 13783 - DNA, 301 bp, Homo sapiens; identical to SEQ ID NO: 9831

SEQ ID NO: 13784 - DNA, 299 bp, Homo sapiens
tcttttcttttttttgagacggagtctcgtgctgtcacccaggctggagtgcggtggtgtgatctcggctcactgcaagctccacctcccgggttcatgccattctcctgcctcagcctcccaagtagctgggactacaggcgctcgccaccacagcgggctaattttttgtatttttagtagagacggggtttcaccgtgttagccaggatggtctcgatctcctgacctcgtgatccgcccgctttggcctcccaaagtgctgggattacaggcgtgagccaccgcgcctggcctat

SEQ ID NO: 13785 - DNA, 288 bp, Homo sapiens
tttttttttttttttttgagacggagtcttgctctgtcacccaggctggagtgcggtggcgcgatctcggctcactgcaagctccacctcctgggttcacaccattctcctgcctcagcctcccaagtagaggggactacaggcacccgccaccacacctggctaatttttttgtatttttagtagaaacagggtttcactgtgttaaccaggatggtctcgatctcctgaccttgtgatctgcctgccttggcctcccaaagtgctgggattacaggcgtgagccac

SEQ ID NO: 13786 - DNA, 1209 bp, Homo sapiens
tttttttttttttttttttttttttttgagagggtgtcttgctctgtcacccaagctggagtgtggtggcgcgatctcggatcactgcaacctctatgtcccgggttcaagctgttctcctgcctcagcctcccgagtagctgggactagaggcatgtgccaccacgcccagctaatttgtatttttagcagagacggggttttgccatgttggccagactggtctcgaattcctgacctcaggtaatctgcctgcctctgcctcccaaagtgctggggttacaggcatgagccactgtgcctggccaaggtgcatatgtcttgtatctggcattatagtatcatacagtatcatattcacagtgcacagtatcatattcacagtgcacagtatcatattcgttgtgctaaaaatctgccaattcatctctcccttcccataggccctgggcaatcctgacctttttttttttttttctttgatacagagtcttgctctgtcacccaggctgcagtgcaatggcacgatcttggctcactacaatcccgcttcctggttccagcgattctcctgcctcagcctccctagtagctgtgattacaggcacataccaccacgcctggctaatttttttgtatttttattagagatggggttttgccattttggtcaggctggtctcgaactcctgacctcagatgatctgcccaccttggcctcccaaagtgctgggattacaggcatgagccaccacgcctggcccacttttttttttttagacaaggtctcgctctgttgcccaggttggagcgcagagtggcacaatcataaactcactgcagcctccatctcctgggctcagatgatcctcccacctcagcctcccaagtagctgggactataggtgtgtgccaccacacccagctaatttttttttttttgagacggagtatcgctctgtctcccaggttggagtgcagtggtgccatctctgctcactgcaagctctgcctcctgggttcacgccattctcctgcctcagcctcccgagtagctgggactacaggcgcccaccactatgcccggctaattttttgtatttttagtagagatggggtttcaccgtgttagccaggatggtctcaatttcctgaccttgtgatctgcctgcctcggcctcccaaagtgctgggattacaggtgtgaat

SEQ ID NO: 13787 - DNA, 131 bp, Homo sapiens
ttttttttttgagatagagtttcactctgtcgcccaggctggagtgcagtggcgctatctcggctcactgcaagctccgcctcctgggttcacgccattctcctgcctcagcctcccaagtagctggaact

SEQ ID NO: 13788 - DNA, 823 bp, Homo sapiens
aagaatgctaaaaacagtcccccaatctcttctgacttgtaaagtttctgctgagaagtctgctgttagcatgatgagttatatgaccctttctctagctgtctttaagattctttcttttgtattgaccttggaaagtctgacggctatgtgctctggggatgatcatcttgtacagcaggaagagtcattctcaccctcgatcttagcaaccttagcatatgatttttattcccttgcttaaattaataacttttaccttttcgctttaagaaagcactttacagcttctctggcatatctgaattgctagcatcattacacttgtgctttggggccattagtaagataaaggttacttgaaaacaagcactgagatacagtgacagtccgtgacaactgagatggctactaagtgactaatgggtggggagaatttaagcatgaatatgccgcacaaagcaagaattcacatcatggatgctactcagaatagtgtgtaatttaaaacttatgaattgtttatttctggaattttccatttaatatttttagactacagctgaccatgcgtaattgaatgtggaaaggaaaattgcagatatggggggactactgtattaaaaaactaggacagaaaattctgtggcctgaaagacttgatccttcaggaaaatctgaacatctttgctttgtagttcaaatgtcagtaggttaagcatactgcccttgaatgtaattgtttctcaaatcttacaagagctcagagatgcaaagaaaggagccaagtgtcatgttaaacagtgttttgagtaagaaaaca

SEQ ID NO: 13789 - DNA, 185 bp, Homo sapiens
ctctactaaaaatacaaaaaaattagccgggcatggtggtggatgcctgtagtcccagctacttgggaggctgaggcaggagaatggcgtgaacccagggcgcggagcttgcagtaagccgagatggcaccactgcactccagcctgggcgacagagtgagactccgtctcaaaaaaaaaaaaaa

SEQ ID NO: 13790 - DNA, 1656 bp, Homo sapiens
catgatcatattatctacaaacagtaacattttttcttcttttgcaggcaggagagctttgttctcctttttcttgcctaattgttctgatacaaacttttggtaataatgttaagatagaagctgtggtcctggaggcatgcttgcagatcttggcttcagctgtggtccctgaagcagccctgtgtctgtatattttaaggatttaacaatgattacagtttgtataatctgttttttgacaggtaaacatctccttttgttgggtccccaggctgatgagattacctctggggttgcagagaagaagggttgtagctgagtctcaagggtgctgctgggtctgctgtgtggcctgcctttgagggttgtgttaccagagatttagacagtcacagattctttctgggccctggaaagattagatttccttgaggacattaatctatatggcaggcagtaggattgggttttgaaatttgtctgcatatgatggcccaaataccaggtgtataaatgggtttagcttttactgactacctgggaacagtttttttttttcttttttttgtgacggaatctggttctgtcgcccaggctggagtgtagtgccatgaacttggctcactgcaacctccgcctcccaggttcaagcgattctcctgcctcagcctcccaactagctgggagtacaggcgcttccatcacacccagctaatttttttttttttttgagtcggagtctcactctgtcacccaggctggagtgcagtggtgctatctcagctcactgcaagctccgcctgctgggttcatgccattctcctgcctcagccccccaagtagctgggactaaaggcgcccgtcaccgtgccaggctaattttttgtatttttaatagagacagggtttcaccgcggtctcgatctcctgacctcgtgatccgcccgcctcggcctcccaaagtgctgggattacaggtgtgagccaccgcacccggcacgctcagctaattttttgtatttttagtagagacggggtttcactgtgttagccaggctggtcttgatctcctgacctcctgatttgcccgcctcggcctcccaaagtgctgggcttacaggcgtgagccaccgcgcccagcccctgggaacagtttttataggtctctctgtgggcctctgagtgtgtacgagtggccacggactgtgactacaaatggcttgaactgagtcacagggctgcttcaaggagcacaactgaggccaggatctgcaggcctgcctccagggtcatggctgggtgtgtcttcctgcaggtctcttgatgggaaggaccatttctggactacagctgagattgagaactgcttcataatcctcagtaagaccaagctgcatgcaccattttcttgtctgtagccatgtctatgggctctggagttggccacctgggtgagggcctgctttttccaaataacccttccttggtctttgactccactgaggtttcacaaccctaactataggcaagcaccattctacttatgttttctaggaatttactacttaaaatatcttatgtaagtggaatcatacattgtcactttgttagtgtcttattaaataatggtgtctaaatagtgtcttattaaaa

SEQ ID NO: 13791 - DNA, 184 bp, Homo sapiens
ccgtctctactaaaaatacaaaaaaattagctgggcgtggtgcgggcgcctgtagtcccagctactcgggaagctgaggcaggagaatggcgtgaatccaggaggcggagcttgcagtgagccgagattgcgccactgcactccagtctgggcgacagagcgagactccacctcaaaaaaaaaa

SEQ ID NO: 13792 - DNA, 773 bp, Homo sapiens
tcaacatccagccttagaaatagctccctttaggtcaccaaattaacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgacatagtgggagaggggggcttccttctaagtaatagagaagagtgaatattctaatcattgagtagtggtcaggcctgtaatcactgctttttcttttgctgagctcggtatcaacggacaagctcaaaaattgtagctatttaaaattactctccatgtaaagggttcctgttcctttgatcctatcacagactattcctttttttctattgaggaggttcataagatctcgtgggcaagggctgaggagatgactattgcgtagtgtagttgttttaaattaaaaatttacctctagttataggtgctactttttacttaccctcaatttggagattacatcatgcaggctgggcacagtggttcatgcctgtaaccccagtgctttaggaggccaaggcgggagaattgctaaaggccaggaattagagaccaccctgggcaacacagcaaggcgtcatctctaccaaaaaaaaaaaaa

SEQ ID NO: 13793 - DNA, 774 bp, Homo sapiens
tcaacatccagccttagaaatagctccctttaggtcaccaaattaacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgacatagtgggagaggggggcttccttctaagtaatagagaagagtgaatattctaatcattgagtagtggtcaggcctgtaatcactgctttttcttttgctgagctcggtatcaacggacaagctcaaaaattgtagctatttaaaattactctccatgtaaagggttcctgttcctttgatcctatcacagactattcctttttttctattgaggaggttcataagatctcgtgggcaagggctgaggagatgactattgcgtagtgtagttgttttaaattaaaaatttacctctagttataggtgctactttttacttaccctcaatttggagattacatcacgcaggctgggcacagtggttcatgcctgtaaccccagtgctttaggaggccaaggcgggagaattgctaaaggccaggaattagagaccaccctgggcaacacagcaaggcgtcatctctaccaaaaaaaaaaaaaa

SEQ ID NO: 13794 - DNA, 771 bp, Homo sapiens
tcaacatccagccttagaaatagctccctttaggtcaccaaattaacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgacatagtgggagaggggggcttccttctaagtaatagagaagagtgaatattctaatcattgagtagtggtcaggcctgtaatcactgctttttcttttgctgagctcggtatcaacggacaagctcaaaaattgtagctatttaaaattactctccatgtaaagggttcctgttcctttgatcctatcacagacttcctttttttctattgaggaggttcataagatctcgtgggcaagggctgaggagatgactattgcgtagtgtagttgttttaaattaaaaatttacctctagttataggtgctactttttacttaccctcaatttggagattacatcatgcaggctgggcacagtggttcatgcctgtaaccccagtgctttaggaggccaaggcgggagaattgctaaaggccaggaattagagaccaccctgggcaacacagcaaggcgtcatctctaccaaaaaaaaaaaaa

SEQ ID NO: 13795 - DNA, 560 bp, Homo sapiens
ccaaattaaaattaggcgtgtctggtcaacagtgatcacgttgcatgcttttagctttgcttgttgaagttgcttctcctccccgagtggctttcctccccacaattttttttttttgaaggaaatatcataagctctttcagaaatactcacaggaagtgagagtccgtatgctggttactcaccagcaactgagtgttggcaggtggagaatgctaccgcagcccgcccagacggatctgcagactggccccatcgcagaggattagacagagggtgcatggatcatagggtttttgaaaagaagggagttttaagaggaaattggtcactgcgtgtcatctcgaggggtggtgattcagggagcagggctgggggtcagaaggcacgtggctgccatctcagaggttgctgctcacttctcagagggcaggctggcttctaaaaatcaacgctccctccacccccaaacagcgattcttctgcagtgaatcacttccagaaatgaatagccacagttttttggaatgaacgttgtgaaatccctcctttataatggc

SEQ ID NO: 13796 - DNA, 6175 bp, Homo sapiens
tctagttcatcagaaacaagtttaattcgggaactgtagtttatccaggttccgtgaaggcaattagcactgggcaaagggctgtttgatcagcctagagagagaccgcctttacgcctaaagctccagtcatttgtctctactcccgccgactcgcagcggccacagaagacatcagaactggatgaaaatggccctgcccctgcgacagagcagggcgcttctggcttgcgccttgttatttgtccctccagtggttcctagctgttgtgacgtcaaggctgccattcagagcagagaaaaaggaaaccatggcctctcttcgcatcagtagcccggacaagctgttgtttctcaggcatccaaagcgctttctgtctggcagagctgtgcattccatgcctgggtgacctggttaaatggaggaaaccaaatgctatccgctgaatgctctccaaaacaagcattccgccctgcgcgtctcaagcacaggcttcactgcctccgaggactgtgaagggaacagcagcactgcctgcatttgctgctggcatattcagcttctggtcagggtcttaaaggagaaaataacatcctcaatggcctcgattaatgcacactcaccaacgtgtttgtgctgcctttggggtcagtgctacaaaatccttttttaaaaaaggattcggaatcacagtcagaagttcaaaactgctgaactgccacctcttccttcctgtctcacttcggctcacgccattccccaatttcaggtttctgaattccagaaaggctcttgtgtatgtgaacatattaatcttgcaccgtgccttactgaacgtgtgtatgttttgcacacacatgagaaagactcacaagtataatgcgtggatcacaactctaggattttctcaatgaagagtaacaccttatgcttttcagagaaaaggggctatttcacagtgtcacagaactctccttaggagcaagccaagatctctgtagcaaacatcaatcctgcaaggccaaaagctcactaataaagttctgatcacgtagagtgactgcctaagaattgaccaacttcagactaaattttctgaggacataccttcttgggtttctttctggcatgagagactattttattagattcttggattcaattatagtcaccagaaaaagcaaggttataacaaccacgctttgtgttccagagttgtcttagttaactcagtattcatttgaggttttatgttacaaatcccattaaatctttctcaaaatagcccttctctgaacatttgatggaagaatatttgcaggaaccaaaaccatttgatatatacaccggtatatgtcaggaaggatcgtgatacaggggtgccttttaaaagtgggttattatacgacagaattcttccaggtccctgactcttgtcttctgaaaaaaaaaaaagtggagatcttcagaggactggataaagacagaatggatggggtgaattatgtaaagttaggatttagactgagggtttacagggctgcagtctcgttttgcctcaacagtcagacttgcccagggtctggcctaataccatacaaatgtcatatccacagtggcattgatacagtggtgggaatggggcatgggggtgatgagcatagcttcttgctgagtgctctggtccgggtgagcctgagatcttgagagaaaaactaggacattatttccatcgtgggctgaagaattagttctgctacttgcatatcagttaatccttttctttttttttttttttttttttttgctattactaccatttcaggaggtacttgttatctgaagataactgatacaggaccactactgctgttttaagaggattgacttaaaactgaatcacacatttaaaaacaaacagtcactttttttttaaagatcttattgggactaagtcctgaaaaaaataaaactaaagttgaagtttagtttgttttatataatagaaatttgggatatgatgcaacagcatgttatttcttagaagaaagattgaatgttgacttctaaagcagaatcatataaagaagatgatttttgtacaagcattcgaatttccccaaaggcctctcttaatcttttgatatacaaaccattctcttgaagagtctacctctcatgtaatcacctctgttgactttctcttcaattgttaactgttgaaactgtctttcatcttgtcagtgaccctatgtgattcatgcagtttgctggtatcatttttatcaactgtgtgaaaatctgcaattccaccttacaagtgagctacattggattttcattttattctatgacattattcaaccaagaaagtgagcaagaatagatgctgatgttaatgaggactaataataagtgatcactgtgtttgtcaatatttttatatgatgatgacctttgcttccttatgcaacttggtaactacagggattcagataatgattactcgagtaatgaatccccaccccctgccaaatattatgttgtgtttaaagtactcagtatggtttagtgggctttataatcaaccacatgtagatttggaagccacccctgacacttcactgagttctataaccttgagtgtgctattcacagaacctaagattcttgatcttttatgtagagtaacaaaaccaaccttgcatcctctagacattgtaaagtcacagaaaagttttgaggaatgcagcgacatgaattttactacattttagaagaccacagctggggactctgtatgccccgcatcagctaataccatttgataggcatttttttcatggcataggtgagaacactaaggcccaaggatatgatgtactttcttggcatcacatggtttggttctggcacagccaagcctagaacccaaccttcctactgcctgctgtgtttcttcaccacccagttgctccttggcaagtgaaccaattacaaaggctgtcttacttgtccaaggacagagagaaaggtgcatcctgggtgactggaaatgggagtgggagggagaggatggaggcagcagacattgaaagtaagtattgactagacttggtgacagaatggctcagctcggctcagtgaagaagggagtccagaggccaaactttcaaccctggtgggatggctatacagttaagtaaagtaaaatcagtagaatggtgttggtttttttgcttcatgatgaatttaaagggactgccttatccagatagaaatatgttaaagatataggtaggagaggtagctaccattaaagatacagatttgagattaatgccacagaaggagagctgaaaccactgtactacatataaccgtgtgtgtgtgtgttgcacatgtgcgcacacgcacttgtgttaaactggatttgttggcgtatctccaattcaaacctgggtcaggtgattatgttgtaacttactgcccagttataatcacaaactgttacaccttcatcagaaggaagagcgagttccctagatcagtgtgtttgtgtgtttgttttgttggatggatcctgccgaggcactgagagacagactttgctgggccctgttttgtaaacaaatctgttcacgcacgctttcttctatcattggatgtgtacactggctctgattttcccacccgacacgccaaagcctaagcatttagaagcttgttttcttttagaagtaggcaggcaccaaagaaaaacctgcatatgcatttaaagtgtgcacatctaccctaagtaagtctttggatctttacagttttaactctgggccatgtacagtgtatttcagcccactacacacggcagacctgcgagacgtcctgacagcccccacaaaactatggactgagcttagtgcaaaagagaaagcccttcttacccttaaagttcactgcacgggccattgtgggattagtcaccccagatgataaaacataatactggttttcctaagtaggggtgattcagctttctcttagattggaatatgaacttaatgtatataatacatacagtcacttcctgaacttgtagttttttgcatgttttatttaatattctagccaggtttaagtttttatggcaggaagtatgtgaatggttatgacaggagtaaataacagttgattttatgattacagtacaggaagtaacttttcacaccaaataaatctttgggaaaaaagtgctggcttataaatttaacgtacataaattttccagaatcttgcatacagtcgcctgtgctctcttaaatggaactaaatacctggctggtcttttttcttttaacttttttttgtcaacgaatgtctttgttttagaaagaggcattttcaagtgttttgatgtgacccaacgtgacctaaaaccattaaaagattctaagcaaaaataataaggccaaactttagtgtaaatagcatgaaaggcttgaaaactaaataaaaaattattttttcctttaagagtaaatagctaggctaggcatggtagttcatacctgtgaacctgtgaaccattgctttggggggctgaggtgaaaggattgcttgagcccagaatttcaagacgagcctgggcaacatagcaagaccccttctctattaaaaaaaaaaaaatagccagatgtggcacacgcctgtagtcccaactactcaagaaactggggcaggaggatcacttgagcccaggagtttgaggctgcagtgagctatgatcacgccactgtacgccagcctaggcaacagagcggggggctctgtcttaaatgaccaaatcatttttcatcattaaagcccgggaagcctccaaactgccaccgagtcaagttccttccagtgactcctatagccatgatctgcaggcacttgggaggaacagcctgttaacatcagagaggctgttgcatgtgaacaagtttacagagaagaggaaagaattggatagaacttcagttacatttcattgtaagcagagctttaacagaggctttgtttttccttgaataaaaaaatgaatagcgggaatacaagatttagagaagatttctttcttcacccttttcatcttaaagcctaaagatgttgtaatgagaaaaatattgtgacattcctttctgaaggttactattacacacacgtgaattatgtgaacgaatgggtggatgcctggcagattaaaatgtagagttccagatgcattcataaccaccatgtggctatgacacagtggcacatcattgggctgggagtgaaaggatgaaggttcagacttcagccctgtgtctgggagcctcacccaaccaccctgacggaaaacaggatctctgaatcccttctacctctacaactcggtaccacacattgtgcaactaagtaacttgcaagttatgtgaaactgttttcacaggatcagcagagttaccactgcttcgttgtcctgaatcttcattacatttttacagacaatatatttgcatgtgacatgattaaaaatctaccttgtgtttttatggtctttgtaggttttaaggtagtttcttatatgctgttttccttgctgtgcagccaacctgggtgttactggcagacatgctgagggcaggctctggatgtggagtcaaggtcaggctccctggctctgaatcctggctcaaccacctactgattgtgtaaccctgggcatgtccttaagcacccagggcctcagtttccttatctgtaggatgaggattaaaaatagaacttacctccagggctgctgtgaagattaaacgaatggacggatgtgtagctcgtggtagcgcctgagctggccctgcatgtcagtgtgctgttctcgctgatgatgaaactggcttagcgaggttgggtgatatgcataagagcaaattagcaaaaaagatgagccagaactcaaacacggccttaggacttctcagtggctggtgcccttccgttgtgagaccactctctctcctgcctataaaagtgccacgaaagagtgcgctccatttcattgtttaaaagagaactgagtaaatgttaaacatgaaggtcatttgtcacggggttttactttgtttggagagggtggactctataact

SEQ ID NO: 13797 - DNA, 6171 bp, Homo sapiens
tctagttcatcagaaacaagtttaattcaggaactgtagtttatccaggttccgtgaaggcaattagcactgggcaaagggctgtttgatcagcctagagagagaccgcctttacgcctaaagctccagtcatttgtctctactcccgccgactcgcagcggccacagaagacatcagaactggatgaaaatggccctgcccctgcgacagagcagggcgcttctggcttgcgccttgttatttgtccctccagtggttcctagctgttgtgacgtcaaggctgccattcagagcagagaaaaaggaaaccatggcctctcttcgcatcagtagcccggacaagctgttgtttctcaggcatccaaagcgctttctgtctggcagagctgtgcattccatgcctgggtgacctggttaaatggaggaaaccaaatgctatccgctgaatgctctccaaaacaagcattccgccctgcgcgtctcaagcacaggcttcactgcctccgaggactgtgaagggaacagcagcactgcctgcatttgctgctggcatattcagcttctggtcagggtcttaaaggagaaaataacatcctcaatggcctcgattaatgcacactcaccaacgtgtttgtgctgcctttggggtcagtgctacaaaatccttttttaaaaaaggattcggaatcacagtcagaagttcaaaactgctgaactgccacctcttccttcctgtctcacttcggctcacgccattccccaatttcaggtttctgaattccagaaaggctcttgtgtatgtgaacatattaatcttgcaccgtgccttactgaacgtgtgtatgttttgcacacacatgagaaagactcacaagtataatgcgtggatcacaactctaggattttctcaatgaagagtaacaccttatgcttttcagagaaaaggggctatttcacagtgtcacagaactctccttaggagcaagccaagatctctgtagcaaacatcaatcctgcaaggccaaaagctcactaataaagttctgatcacgtagagtgactgcctaagaattgaccaacttcagactaaattttctgaggacataccttcttgggtttctttctggcatgagagactattttattagattcttggattcaattatagtcaccagaaaaagcaaggttataacaaccacgctttgtgttccagagttgtcttagttaactcagtattcatttgaggttttatgttacaaatcccattaaatctttctcaaaatagcccttctctgaacatttgatggaagaatatttgcaggaaccaaaaccatttgatatatacaccggtatatgtcaggaaggatcgtgatacaggggtgccttttaaaagtgggttattatacgacagaattcttccaggtccctgactcttgtcttctgaaaaaaaaaaaagtggagatcttcagaggactggataaagacagaatggatggggtgaattatgtaaagttaggatttagactgagggtttacagggctgcagtctcgttttgcctcaacagtcagacttgcccagggtctggcctaataccatacaaatgtcatatccacagtggcattgatacagtggtgggaatggggcatgggggtgatgagcatagcttcttgctgagtgctctggtccgggtgagcctgagatcttgagagaaaaactaggacattatttccatcgtgggctgaagaattagttctgctacttgcatatcagttaatccttttcttttttttttttttttttttgctattactaccatttcaggaggtacttgttacctgaagataactgatacaggaccactactgctgttttaagaggattgacttaaaactgaatcacacatttaaaaacaaacagtcactttttttttaaagatcttattgggactaagtcctgaaaaaaataaaactaaagttgaagtttagtttgttttatataatagaaatttgggatatgatgcaacagcatgttatttcttagaagaaagattgaatgttgacttctaaagcagaatcatataaagaagatgatttttgtacaagcattcgaatttccccaaaggcctctcttaatcttttgatatacaaaccattctcttgaagagtctacctctcatgtaatcacctctgttgactttctcttcaattgttaactgttgaaactgtctttcatcttgtcagtgaccctatgtgattcatgcagtttgctggtatcatttttatcaactgtgtgaaaatctgcaattccaccttacaagtgagctacattggattttcattttattctatgacattattcaaccaagaaagtgagcaagaatagatgctgatgttaatgaggactaataataagtgatcactgtgtttgtcaatatttttatatgatgatgacctttgcttccttatgcaacttggtaactacagggattcagataatgattactcgagtaatgaatccccaccccctgccaaatattatgttgtgtttaaagtactcagtatggtttagtgggctttataatcaaccacatgtagatttggaagccacccctgacacttcactgagttctataaccttgagtgtgctattcacagaacctaagattcttgatcttttatgtagagtaacaaaaccaaccttgcatcctctagacattgtaaagtcacagaaaagttttgaggaatgcagcgacatgaattttactacattttagaagaccacagctggggactctgtatgccccgcatcagctaataccatttgatagccatttttttcatggcataggtgagaacactaaggcccaaggatatgatgtactttcttggcatcacatggtttggttctggcacagccaagcctagaacccaaccttcctactgcctgctgtgtttcttcaccacccagttgctccttggcaagtgaaccaattacaaaggctgtcttacttgtccaaggacagagagaaaggtgcatcctgggtgactggaaatgggagtgggagggagaggatggaggcagcagacattgaaagtaagtattgactagacttggtgacagaatggctcagcttggctcagtgaagaagggagtccagaggccaaactttcaaccctggtgggatggctatacagttaagtaaagtaaaatcagtagaatggtgttggtttttttgcttcatgatgaatttaaagggactgccttatccagatagaaatatgttaaagatataggtaggagaggtagctaccattaaagatacagatttgagattaatgccacagaaggagagctgaaaccactgtactacatataaccgtgtgtgtgtgtgttgcacatgtgcgcacacgcacttgtgttaaactggatttgttggcgtatctccaattcaaacctgggtcaggtgattatgttgtaacttactgcccagttataatcacaaactgttacaccttcatcagaaggaagagcgagttccctagatcagtgtgtttgtgtgtttgttttgttggatggatcctgccgaggcactgagagacagactttgctgggccctgttttgtaaacaaatctgttcacgcacgctttcttctatcattggatgtgtacactggctctgattttcccacccgacacgccaaagcctaagcatttagaagcttgttttcttttagaagtaggcaggcaccaaagaaaaacctgcatatgcatttaaagtgtgcacatctaccctaagtaagtctttggatctttacagttttaactctgggccatgtacagtgtatttcagcccactacacacggcagacctgcgagacgtcctgacagcccccacaaaactatggactgagcttagtgcaaaagagaaagcccttcttacccttaaagttcactgcacgggccattgtgggattagtcaccccagatgataaaacataatactggttttcctaagtaggggtgattcagctttctcttagattggaatatgaacttaatgtatataatacatacagtcacttcctgaacttgtagttttttgcatgttttatttaatattctagccaggtttaagtttttatggcaggaagtatgtgaatggttatgacaggagtaaataacagttgattttatgattacagtacaggaagtaacttttcacaccaaataaatctttgggaaaaaagtgctggcttataaatttaacgtacataaattttccagaatcttgcatacagtcgcctgtgctctcttaaatggaactaaatacctggctggtcttttttcttttaacttttttttgtcaacgaatgtctttgttttagaaagaggcattttcaagtgttttgatgtgacccaacgtgacctaaaaccattaaaagattctaagcaaaaataataaggccaaactttagtgtaaatagcatgaaaggcttgaaaactaaataaaaaattattttttcctttaagagtaaatagctaggctaggcatggtagttcatacctgtgaacctgtgaaccattgctttggggggctgaggtgaaaggattgcttgagcccagaagttcaagacgagcctgggcaacatagcaagaccccttctctattaaaaaaaaaaaatagccagatgtggcacacgcctgtagtcccaactactcaagaaactggggcaggaggatcacttgagcccaggagtttgaggctgcagtgagctatgatcacgccactgtacgccagcctaggcaacagagcggggggctctgtcttaaatgaccaaatcatttttcatcattaaagcccgggaagcctccaaactgccaccgagtcaagttccttccagtgactcctatagccatgatctgcaggcacttgggaggaacagcctgttaacatcagagaggctgttgcatgtgaacaagtttacagagaagaggaaagaattggatagaacttcagttacatttcattgtaagcagagctttaacagaggctttgtttttccttgaataaaaaaatgaatagcgggaatacaagatttagagaagatttctttcttcacccttttcatcttaaagcctaaagatgttgtaatgagaaaaatattgtgacattcctttctgaaggttactattacacacacgtgaattatgtgaacgaatgggtggatgcctggcagattaaaatgtagagttccagatgcattcataaccaccatgtggctatgacacagtggcacatcattgggctgggagtgaaaggatgaaggttcagacttcagccctgtgtctgggagcctcacccaaccaccctgacggaaaacaggatctctgaatcccttctacctctacaactcggtaccacacattgtgcaactaagtaacttgcaagttatgtgaaactgttttcacaggatcagcagagttaccactgcttcgtcgtcctgaatcttcattacatttttacagacaatatatttgcatgtgacatgattaaaaatctaccttgtgtttttatggtctttgtaggttttaaggtagtttcttatatgctgttttccttgctgtgcagccaacctgggtgttactggcagacatgctgagggcaggctctggatgtggagtcaaggtcaggctccctggctctgaatcctggctcaaccacctactgattgtgtaaccctgggcatgtccttaagcacccagggcctcagtttccttatctgtaggatgaggattaaaaatagaacttacctccagggctgctgtgaagattaaacgaatggacggatgtgtagctcgtggtagcgcctgagctggccctgcatgtcagtgtgctgttctcgctgatgatgaaactggcttagcgaggttgggtgatatgcataagagcaaattagcaaaaaagatgagccagaactcaaacacggccttaggacttctcagtggctggtgcccttccgttgtgagaccactctctctcctgcctataaaagtgccacgaaagagtgcgctccatttcattgtttaaaagagaactgagtaaatgttaaacatgaaggacatttgtcacggggttttactttgtttggagagggtggactctataact

SEQ ID NO: 13798 - DNA, 560 bp, Homo sapiens
ccaaattaaaattaggcgtgtctggtcaacagtgatcacgttgcatgcttttagctttgcttgttgaagttgcttctcctccctgagtggctttcctccccacaattttttttttttgaaggaaatatcataagctctttcagaaatactcacaggaagtgagagtccgtatgctggttactcaccagcaactgagtgttggcaggtggagaatgctaccgcagcccgcccagacggatctgcagactggccccatcgcagaggattagacagagggtgcatggatcatagggtttttgaacagaagggagttttaagaggaaattggtcactgcgtgtcatctcgaggggtggtgattcagggagcagggctgggggtcagaaggcacgtggctgccatctcagaggttgctgctcacttctcagagggcaggctggcttctaaaaatcaacgctccctccacccccaaacagcgattcttctgcagtgaatcacttccagaaatgaatagccacagttttttggaatgaacgttgtgaaatccctcctttataatggc

SEQ ID NO: 13799 - DNA, 560 bp, Homo sapiens
ccaaattaaaattaggcgtgtctggtcaacagtgatcacgttgcatgcttttagctttgcttgttgaagttgcttctcctccccgagtggctttcctccccacaattttttttttttgaaggaaatatcataagctctttcagaaatactcacaggaagtgagagtccgtatgctggttactcaccagcaactgagtgttggcaggtggagaatgctaccgcagcccgcccagacggatctgcagactggccccatcgcagaggattagacagagggtgcatggatcatagggtttttgaacagaagggagttttaagaggaaattggtcactgcgtgtcatctcgaggggtggtgattcagggagcagggctgggggtcagaaggcacgtggctgccatctcagaggttgctgctcacttctcagagggcaggctggcttctaaaaatcaacgctccctccacccccaaacagcgattcttctgcagtgaatcacttccagaaatgaatagccacagttttttggaatgaacgttgtgaaatccctcctttataatggc

SEQ ID NO: 13800 - DNA, 6172 bp, Homo sapiens
tctagttcatcagaaacaagtttaattcgggaactgtagtttatccaggttccgtgaaggcaattagcactgggcaaagggctgtttgatcagcctagagagagaccgcctttacgcctaaagctccagtcatttgtctctactcccgccgactcgcagcggccacagaagacatcagaactggatgaaaatggccctgcccctgcgacagagcagggcgcttctggcttgcgccttgttatttgtccctccagtggttcctagctgttgtgacgtcaaggctgccattcagagcagagaaaaaggaaaccatggcctctcttcgcatcagtagcccggacaagctgttgtttctcaggcatccaaagcgctttctgtctggcagagctgtgcattccatgcctgggtgacctggttaaatggaggaaaccaaatgctatccgctgaatgctctccaaaacaagcactccgccctgcgcgtctcaagcacaggcttcactgcctccgaggactgtgaagggaacagcagcactgcctgcatttgctgctggcatattcagcttctggtcagggtcttaaaggagaaaataacatcctcaatggcctcgattaatgcacactcaccaacgtgtttgtgctgcctttggggtcagtgctacaaaatccttttttaaaaaaggattcggaatcacagtcagaagttcaaaactgctgaactgccacctcttccttcctgtctcacttcggctcacgccattccccaatttcaggtttctgaattccagaaaggctcttgtgtatgtgaacatattaatcttgcaccgtgccttactgaacgtgtgtatgttttgcacacacatgagaaagactcacaagtataatgcgtggatcacaactctaggattttctcaatgaagagtaacaccttatgcttttcagagaaaaggggctatttcacagtgtcacagaactctccttaggagcaagccaagatctctgtagcaaacatcaatcctgcaaggccaaaagctcactaataaagttctgatcacgtagagtgactgcctaagaattgaccaacttcagactaaattttctgaggacataccttcttgggtttctttctggcatgagagactattttattagattcttggattcaattatagtcaccagaaaaagcaaggttataacaaccacgctttgtgttccagagttgtcttagttaactcagtattcatttgaggttttatgttacaaatcccattaaatctttctcaaaatagcccttctctgaacatttgatggaagaatatttgcaggaaccaaaaccatttgatatatacaccggtatatgtcaggaaggatcgtgatacaggggtgccttttaaaagtgggttattatacgacagaattcttccaggtccctgactcttgtcttctgaaaaaaaaaaaagtggagatcttcagaggactggataaagacagaatggatggggtgaattatgtaaagttaggatttagactgagggtttacagggctgcagtctcgttttgcctcaacagtcagacttgcccagggtctggcctaataccatacaaatgtcatatccacagtggcattgatacagtggtgggaatggggcatgggggtgatgagcatagcttcttgctgagtgctctggtccgggtgagcctgagatcttgagagaaaaactaggacattatttccatcgtgggctgaagaattagttctgctacttgcatatcagttaatccttttctttttttttttttttttttttgctattactaccatttcaggaggtacttgttatctgaagataactgatacaggaccactactgctgttttaagaggattgacttaaaactgaatcacacatttaaaaacaaacagtcactttttttttaaagatcttattgggactaagtcctgaaaaaaataaaactaaagttgaagtttagtttgttttatataatagaaatttgggatatgatgcaacagcatgttatttcttagaagaaagattgaatgttgacttctaaagcagaatcatataaagaagatgatttttgtacaagcattcgaatttccccaaaggcctctcttaatcttttgatatacaaaccattctcttgaagagtctacctctcatgtaatcacctctgttgactttctcttcaattgttaactgttgaaactgtctttcatcttgtcagtgaccctatgtgattcatgcagtttgctggtatcatttttatcaactgtgtgaaaatctgcaattccaccttacaagtgagctacattggattttcattttattctatgacattattcaaccaagaaagtgagcaagaatagatgctgatgttaatgaggactaataataagtgatcactgtgtttgtcaatatttttatatgatgatgacctttgcttccttatgcaacttggtaactacagggattcagataatgattactcgagtaatgaatccccaccccctgccaaatattatgttgtgtttaaagtactcagtatggtttagtgggctttataatcaaccacatgtagatttggaagccacccctgacacttcactgagttctataaccttgagtgtgctattcacagaacctaagattcttgatcttttatgtagagtaacaaaaccaaccttgcatcctctagacattgtaaagtcacagaaaagttttgaggaatgcagcgacatgaattttactacattttagaagaccacagctggggactctgtatgccccgcatcagctaataccatttgatagccatttttttcatggcataggtgagaacactaaggcccaaggatatgatgtactttcttggcatcacatggtttggttctggcacagccaggcctagaacccaaccttcctactgcctgctgtgtttcttcaccacccagttgctccttggcaagtgaaccaattacaaaggctgtcttacttgtccaaggacagagagaaaggtgcatcctgggtgactggaaatgggagtgggagggagaggatggaggcagcagacattgaaagtaagtattgactagacttggtgacagaatggctcagctcggctcagtgaagaagggagtccagaggccaaactttcaaccctggtgggatggctatacagttaagtaaagtaaaatcagtagaatggtgttggtttttttgcttcatgatgaatttaaagggactgccttatccagatagaaatatgttaaagatataggtaggagaggtagctaccattaaagatacagatttgagattaatgccacagaaggagagctgaaaccactgtactacatataaccgtgtgtgtgtgtgttgcacatgtgcgcacacgcacttgtgttaaactggatttgttggcgtatctccaattcaaacctgggtcaggtgattatgttgtaacttactgcccagttataatcacaaactgttacaccttcatcagaaggaagagcgagttccctagatcagtgtgtttgtgtgtttgttttgttggatggatcctgccgaggcactgagagacagactttgctgggccctgttttgtaaacaaatctgttcacgcacgctttcttctatcattggatgtgtacactggctctgattttcccacccgacacgccaaagcctaagcatttagaagcttgttttcttttagaagtaggcaggcaccaaagaaaaacctgcatatgcatttaaagtgtgcacatctaccctaagtaagtctttggatctttacagttttaactctgggccatgtacagtgtatttcagcccactacacacggcagacctgcgagacgtcctgacagcccccacaaaactatggactgagcttagtgcaaaagagaaagcccttcttacccttaaagttcactgcacgggccattgtgggattagtcaccccagatgataaaacataatactggttttcctaagtaggggtgattcagctttctcttagattggaatatgaacttaatgtatataatacatacagtcacttcctgaacttgtagttttttgcatgttttatttaatattctagccaggtttaagtttttatggcaggaagtatgtgaatggttatgacaggagtaaataacagttgattttatgattacagtacaggaagtaacttttcacaccaaataaatctttgggaaaaaagtgctggcttataaatttaacgtacataaattttccagaatcttgcatacagtcgcctgtgctctcttaaatggaactaaatacctggctggtcttttttcttttaacttttttttgtcaacgaatgtctttgttttagaaagaggcattttcaagtgttttgatgtgacccaacgtgacctaaaaccattaaaagattctaagcaaaaataataaggccaaactttagtgtaaatagcatgaaaggcttgaaaactaaataaaaaattattttttcctttaagagtaaatagctaggctaggcatggtagttcatacctctgaacctgtgaaccattgctttggggggctgaggtgaaaggattgcttgagcccagaagttcaagacgagcctgggcaacatagcaagaccccttctctattaaaaaaaaaaaatagccagatgtggcacacgcctgtagtcccaactactcaagaaactggggcaggaggatcacttgagcccaggagtttgaggctgcagtgagctatgatcacgccactgtacgccagcctaggcaacagagcggggggctctgtcttaaatgaccaaatcatttttcatcattaaagcccgggaagcctccaaactgccaccgagtcaagttccttccagtgactcctatagccatgatctgcaggcacttgggaggaacagcctgttaacatcagagaggctgttgcatgtgaacaagtttacagagaagaggaaagaattggatagaacttcagttacatttcattgtaagcagagctttaacagaggctttgtttttccttgaataaaaaaatgaatagcgggaatacaagatttagagaagatttctttcttcacccttttcatcttaaagcctaaagatgttgtaatgagaaaaatattgtgacattcctttctgaaggttactattacacacacgtgaattatgtgaacgaatgggtggatgcctggcagattaaaatgtggagttccagatgcattcataaccaccatgtggctatgacacagtggcacatcattgggctgggagtgaaaggatgaaggttcagacttcagccctgtgtctgggagcctcacccaaccaccctgacggaaaacaggatctctgaatcccttctacctctacaactcggtaccacacattgtgcaactaagtaacttgcaagttatgtgaaactgttttcacaggatcagcagagttaccactgcttcgttgtcctgaatcttcattacatttttacagacaatatatttgcatgtgacatgattaaaaatctaccttgtgtttttatggtctttgtaggttttaaggtagtttcttatatgctgttttccttgctgtgcagccaacctgggtgttactggcagacatgctgagggcaggctctggatgtggagtcaaggtcaggctccctggctctgaatcctggctcaaccacctactgattgtgtaaccctgggcatgtccttaagcacccagggcctcagtttccttatctgtaggatgaggattaaaaatagaacttacctccagggctgctgtgaagattaaacgaatggacggatgtgtagcttgtggtagcgcctgagctggccctgcatgtcagtgtgctgttctcgctgatgatgaaactggcttagcgaggttgggtgatatgcataagagcaaattagcaaaaaagatgagccagaactcaaacacggccttaggacttctcagtggctggtgcccttccgttgtgagaccactctctctcctgcctataaaagtgccacgaaagagtgcgctccatttcattgtttaaaagagaactgagtaaatgttaaacatgaaggtcatttgtcacggggttttactttgtttggagagggtggactctataact

SEQ ID NO: 13801 - DNA, 3706 bp, Homo sapiens
gtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagcta

SEQ ID NO: 13802 - DNA, 334 bp, Homo sapiens
catctcggcaaaaaatataaaaatgagccaggcatggtgatgcaggcctgtagtcccaactactgtgcagggagggccaaggtgggaagatcttttgagcttgggaggcagaggttgcagtgagctgacataccactgcactccagcctgggtgacagaggaagatccttctcaccgccctccccgcccccacccccactaagacagtcttgctctgttgcccagagctggaatgcagtggtgtgacgtcacctcattgcaacctccacctcccgggttcaagcaattcttctgcctcagcctcccctgagtagctgggattacaggtgtgtgc

SEQ ID NO: 13803 - DNA, 2457 bp, Homo sapiens
ggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgttccaaataatttgggcctatgatatcatgtgtatttttatgtctagcttaaaaggtatttgaaaatgttccatttgtgttttattattttctgtcctatgacagttctatgctaaatgtattttaaaataaaagccaaattgaagattaaagaaggttttgctttg

SEQ ID NO: 13804 - DNA, 669 bp, Homo sapiens
atttttattttattttgtagctttctttacaagtagtgtttattaaatatatatttcagggacaacataaaaatgaattcagtggaatgaatagaatttaaaagcaaaatttccctcaccctccctgtcattcattcccttaaaggcaaattttaacagagcattcaataaagataagtaaatactaaagtggttttttaaaatatataatcacaaaaatttttaaaggctactcaagtgaagcagtgggagtggagaaagatatgatcacacaattttatatgacaaagatttcttattggtaaacaattttgttctcgttaacaaggaatgtttattctagatttaaaacctaacgtggccaagtgtggtggttcatgcctgtaatcccagccggccagtaaaatgtttaatctggacatcagtaaggatcagtttttaacattttactttatagctgcattagattttctgaagagggtttttgttgtttgataaggttttttaagaaagggaagaggtagcagtttgagaaaaagtaattagtagatattactgtgctgggtattttctcgttatttgatcaagttcttccattccttttgaaatatatatgtaagttaaaaagaaaaaacttggccagtcgcggtggctcacgcctgtaatcca

SEQ ID NO: 13805 - DNA, 5062 bp, Homo sapiens; identical to SEQ ID NO: 8512

SEQ ID NO: 13806 - DNA, 5061 bp, Homo sapiens; identical to SEQ ID NO: 8513

SEQ ID NO: 13807 - DNA, 5063 bp, Homo sapiens; identical to SEQ ID NO: 8514

SEQ ID NO: 13808 - DNA, 133 bp, Homo sapiens; identical to SEQ ID NO: 8515

SEQ ID NO: 13809 - DNA, 282 bp, Homo sapiens; identical to SEQ ID NO: 8516

SEQ ID NO: 13810 - DNA, 133 bp, Homo sapiens; identical to SEQ ID NO: 8515

SEQ ID NO: 13811 - DNA, 246 bp, Homo sapiens; identical to SEQ ID NO: 8518

SEQ ID NO: 13812 - DNA, 115 bp, Homo sapiens; identical to SEQ ID NO: 8519

SEQ ID NO: 13813 - DNA, 1585 bp, Homo sapiens
cccgcttcaggagaaactgtatgtgccatcccttttctcagagcattatgcacagataattgtgtaactgcatgaaacatatattaaaattaggtcagaagtaaagtatggttggaatttgggtatgcgtctgccacttgtctgtgtctcaagcacttaaaaacatatcctattcctggcacagttcagtgcatttcgggaagtgaccaatagtcagggaaataatcaaggtttctggaacaaaatgcaagagttggcctgagatcactgctctacctagagaggagtagggcaaggccagtctgggccatgattcagagtaaggatgactgacccagccacaggggaggacagtgcccaggacctgtgtactcctatgttcccaatgcctaagagtgcccagcccatggaaagtgttcagtgaatttaatgaataaatgattctacagaaatgggcacggggaaggagaaagggcctgcagtcttttatttttattttattattttttttttgagatggagtctcgcactgtcgcccgggctggagtgcagtggccacaatcttggctcactgcaacctccaccttccaggttaaagcgattctcctgcctcagcctcccaagtagctgggattacaggcgcccgccaaccacgcccggctaattttttgtatttttagtagagatggggtttcactatgttggccaggctggtctcgaatgcctgacctcatgatccgcctgtcttggcctcccaaagtgctgggattacaggcgtgagccactcgcccggccggtcttttattcttcatacaagtgtccttcctgcacatcccagagctatctaagacccattctgatcatcactaatgccagttccctcttctgtaaggggcagtaacacccctggtgctgcctacctcacaggattgtcctgagagaccagcgagattctgcatgtgaaggggctttctctgaatagtgaagttctacaatgtgactcatctttgcggaccctgtcctccacgtgagggtgggagacctctgctcattgccatttcttttcagattctgcagtgttaagttggaaggtttccacggaagccacattattattacataggaagtgacatcactttccagcttgttttggggggccaaaatcttgctatgttcttggccagcacctcagtttccatcctccttccaacccattgtctttctttgtaactctgcctaacaggtctgggaggtccaactttgactgaggatgttaccttcccctccccagtgctgacctcctccctcctagttacttggcataccgggaaccacatcatcaactcctgtgggtaaaaggtgacacatgagccataacactgcttgctttcccagagatgcctgggtttccaggagctgccacatcactcttcctcttttgcatcttaatgttggcagtgggaaagagttagaggtggattcctggacccagtctggcctgcattatttcagcatgtggaatagaggtcactaaccggtgtgccacaggctagtctcagcttgcaaatgtattttgtccacataa

SEQ ID NO: 13814 - DNA, 1585 bp, Homo sapiens; identical to SEQ ID NO: 12039

SEQ ID NO: 13815 - DNA, 102 bp, Homo sapiens
tacctgtaatcccagctacttgggaggctgaggcaggagaatcgcttgaacccaggaggcaaaggttgcagtgagcccagattgcaccactgcactccagcc

SEQ ID NO: 13816 - DNA, 391 bp, Homo sapiens; identical to SEQ ID NO: 12038

SEQ ID NO: 13817 - DNA, 419 bp, Homo sapiens
tgtaaagctggtgggactgccctagatatatctaatacatattcctgcccctcagacacatactctaaaacatggaggcatcacaggaaaataagtagatgaaggaaggctgggcacggtggctcatgcctgtaatcccagcactttggaggcttaggcggccgatcacttgaggtcaggggttcgagacccgcctggccaacatggtgaaaccccgtctttacaaaaatgcaaagtattagccgggcacggtggcatgcacctgtaatcctggctactcaggagcctgaggtaggaagatcccttgaacctaggaggcagaggttgcagtgagccgagatcatgccactgcactccagcctgggcgacagagcaaggctctatctcagaaaaaaaaaaagtagatgaaggaaaagtaa

SEQ ID NO: 13818 - DNA, 1598 bp, Homo sapiens
gaactcctggattcaagcaatcctctctccttggcttcccaaagtgctaggattacaggcgtgagcctctgcacccggcctcagtgtgtgctcttaattgctacactgtgccgccacttggcaatgtcacggccgcttactcttacctatgcaatcctagcatgcctttccttcttctgcttcatgctattgagcactctttgtcatcccacagaattcagttcagccatttgagaaaagcctttcctgactctaacagacaagttatgcacctctttcctgtgcttacatagtagcctgtaccaacattacatttctcattgcattatgattgcaacatctgggcacatctctctaggacgctcagctctgtggaggcaaactctttctcattcagtttgtatgcccagtttaacacctaagcgttagcacacagcagatacttggtaaatgtttgttagctgagtaagggaaaaatagatcttctagccatgaagttttaatagtgttgatgtaaaccagaaggaacatttcaaataaattatgtaattttcaataaaaaaagatatacccttgatctgtaactcacaaaaataatgtattcttctgaaacagtatacaacgaatgtttaattaaccatttgattaaatggctgagtaccctgggccaataaagcaaagtttcattaactcctctaatattcttaacggaaaacctgaagagctgacatatagtagtaaatgaaatgtgggttggtatctcagaccatcacaaatcacctcttaatacaacttcttatcatcacttaacttgaaatactttcaaagatgaagacaaagggtaataaagaagtagcaggatggagttgtactcttggtataagagaaatatacagcaagtcattataatacattagttagtaacagtgacttttctaaggtttcagttgatggttattcatccactacttaattctttcctcttaacaacctaaatgaaaagtcactgcttttaaaataacattttgtcataactctataaaacttttttttttgagacggagtcttgttctgtcacccaggctggagtgcagtggtgtgatctcagctcactgcaacctccgcctcctgggttcaagcaactctcctgcctcagcctcctgagtagctgggactacaggtgcacgctgccatgcccagctaatattctgtattttagtagagatggggtttcacccgttgtccaggctggtcacaaactcctgagctcaggcaatccgcccacctcggcctcccaaagtgctgggattacaggcgtgagccaccatgcctgaccacattaaagcttttaacatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagatcaaaaaaagagaaaaaagaaatgaaaaac

SEQ ID NO: 13819 - DNA, 408 bp, Homo sapiens
aaaaatagaggaagaagccctttctaactctggtcccaaggaacacctgttgcagatgccacttagtctcaagcttagctgtcatgtcctactcataaactcagccatcttccccttctttctcatgccaaccagtatcatatgtcaggctgaatatatccgtgctgatgtcagagaatcacataacaccagaggaaaacaaggccagccagaatgttgctacattttcagagaagaaaaccaaagcaaaaaggccaaaatatagcttccaaattttgcatattgtcattgaaattcaaggtttcagataaagtttgaaactcttgaggccaagtggcgagactgcaattacgttactttttagcagctgcagtttttttctgaatcaagtcatctcactttgtaaaa

SEQ ID NO: 13820 - DNA, 912 bp, Homo sapiens
cctatctccttacagcccgcagacacaaggtaggcaataaaaaatggtttcaactttttcagtatttttacaccaaaagatgctgtcttacaagacctctatcttttgtttgttcctgtttttccctcccttcctcaccaggggagagaaaaaaacggaaggaaagaaaggaggaaatgaatcttaatgagcatctgctgtgtgctaggcacttttaaaaatacctaaggtcatcagataatttacacagaacttgggtggtagtgtgtgaaagactatgcataactgagatgattccatggcagaaaattccaagccatggaaaaaccacatcgtatttatgatggtgcacaaaccgtgatgaagaagagcaagagggaggaaggaaggacagatcccctatcgaatggcaatacttgaggattggggggtaaaaccctaaatgaacttgtagattaattcaaagccagacttactgcttctatagagagactagcacattgtttatatatcagaaagtcctgaattaatttcatgcttaatgccaaaggggttgccataacctttgcctctaagcaaggctgtctctaaataatcatcatatttttaaagttactcagattgcaggatttcctttgacagcctatttctgcttatatcacttttactatagggtgttttgtctttatttctgattttctacccccttcaaccaaagtgtgtttctgcaagcctgttctttgtggaactaatggctttttttttttttttttactgaattataaataccatgaggactttgtatctcccacagttctcatagtaagctttgcacagggtttatggcctgtaaatatttgttgaatgaacagtggaataaataaataaataatggtgatataccaatatatt

SEQ ID NO: 13821 - DNA, 3174 bp, Homo sapiens
acagtccttctacctatgctttagatcccaacccctcctccttttccccaaatcttatactatccaatggcaccaaggatagggcagtgagagcagtctacctggttgcagtcagtaaggcacacagtatctgtagagaacttaaaaagcaatgatgggccgagcgtggaggctcacgctgtaattccagtactttgggaggccgaggcgggtggatcacatgaagtcaggagttcaagaccagcctggccaacatggcgaaaccccatctctactaaaaatacaagaattagccgggcgtggtgctgcacacctgtaatgccagctactcgggatgctgagacaggaaaattgcttgaacccaggaggcaaaggttgcagtgaagcaagatcatgccactgtactccagcctaggccacagagcaagactccgtctcaaaaataaataaataaataaataaaaatataaaaagcaatgatgaaaacgacaaaaaattggtctgctttttactaaaaagtatcactgtgtgcagcaattctaaatgctgtaataaagacctctcctgctgaggcagacagctgcattgcccccttggtatgccgttgctgtcaggtcctcatctctatcgtacagtcattctctctgtctcgtacagtcactctctcagccatattcgtccctcagcagttcatcatgcttattactgtctatttaaaaaagaatcctccatttacttgtcagccacttccattttcaccctctttgtttcctgtttctaatcaaactgctcagaactgtctatacttaaacactattttctcaaatgctcacttctcagcccgttttagttccttctggagctattgccatctaatctcagtagtattcagcaccctgtctctcaaaactcttattttgaatctctcttcttatcttcttttctttcattcttgtttttgttttgagcagggtctggctctgtcgcccaggctggagtgcagtggtgtgatctgggttaattgcaacctctgcctcccaggcgcaagtgatcctcccgcctcaccctcccaagtagctgggactacaggcatgagctcccacacccagctaatttttgtatttttttttgtagagacagggttttgccatgttgtccaagctggtattgaactactgagcttaagcaatccacccgtctcggcctcccaaagtgctgggattacaggcgtcagccaccatgtcctacctactcttcttattttcttacccttcacttcctgctgctcctggtctttcttacaggctcatttttgtctgttaaatgttagatttctcaagttaaggaccaagacttcttgccttctcactccatatcagtggttctcaaattgtagcaagccctcagaatcactggagggcttgttaatacacagactgcagggccccattttcaggttcagagtttctgattcatctggtccagggtgaggcctgagaataagcatttttgttaatttcccaggtaatgttgagcttggtggtccagggaccacactttgagaaccaatgctgtatctctctagattatttcagccacacctgtgactttaattatcatttgaatttaggtaactcctaaatatgtatcttcaacccgatctcttccgagcccccgatccatagatccaactgcatacttaacatctccacttatataccttaaaggcatcaccatttcaacatatccaaaatttaaatttatgacttctgcaccctgcctctaccaccattactaacccctccctgcatgcattctccagaaaaccaactacaacatccaacctgctcctgtgcttctagttttctcttttgagtgaatacaacccacattcataagcccagcaagttacaggcttaaaagtcatcctcaacgtccctgtcttccttcccttcttttgttaccaacccctatcagttttctgtttcttcttgagccagttttggtaaatttaatttttttttttttttttttaatgagacagtccttgctctgtcgccaggctggagtgcagtggcgcgatctcggctcactgcaacctccacctcccaggttcaagcgattctcctgcctcagcctcccaagtagctgagactacaggcatgtgccaccacgcccagctaatttttgtatttttagtagagacagggtttcaccatgttggccaggatagtctccatcacttgaccttgtgatccacctgcctcggcctcccaaagtgctgggattacaggtgtgagccactgcacccggccaaactcaatttttctaagaaattgttttgtttagttttcaaagttatttataatattctctttgtttgtaaaccttctgctttatgttgcttgtctccccttccctcttgtctttcttctcttctctctctctctctgacagatctgtggatttgtcagttttccatgtaattctgtcaagttttgctttatatgttttaaagctatgttattaggtacattcaaattaagaattataatcttccttgtaaattgtttcttctttcatgagtaactgtgtttgtccctatggtgtttttttatcctaaggctttaaaaaacaaatctaaacatagttattagacatcttaattctcttaaaggacacaaggactttagaatgctttgatgttgatcaccacgaattctttcttttctttttttttttttttttttttttttgagacagagtttcactcttgttgcccaggctggagtgcaatggcgtgatctcggctcactgcaacctccgcctccccagttcaagcgattatcctgcctcagcctcctgcgtagctgggattacaggcatgtgccaccatgcccggctaattttgtagttttagtagagacaggatttctccatgttcatcaggctggtctcgaactcctgacctcaggtgatccacccacctcggcctcccaaagtgctgggattacaggtgtgagccaccgtgcctggccatccaccacttcttatcttacattttagtatcacctttattttagtatgccttcaactatcagttactgttttatgtagttaacaatagttactatccatttctttactattccttcttctgcctcactctttctc

SEQ ID NO: 13822 - DNA, 1205 bp, Homo sapiens
attatctgcttctaggttgctaaatatcaatataaagcatattattccagtaagtgccaatgcagttgttagatgctggcgctgaagttagtgctcactgcattctctcttgttggctgtctacttgagtcaccgattggcacagccagagctataaccagtctgtgaggattgatttgccctgacttgtatcttcatgtgtggtctataaggtctgccagattggcttatagtcacaaccagcatgtcctaagcaaaatgaaactatatgaacaaaaatcagctctcatttcactgctagactttggtgttttctttaagaagtagccttgttaatgcttagttttgccttggggaccttaatgtgtcattaactgcctggaaatacctttcatttaaaaaagtatactttagtacctaatgttcaatttagtatcgatctggatattttagcaaattttgacttttcaaagacaaagtttctgtcttgtaatgtttcttgggccggctatactgcctttcatctaaaactcactacagttcactgggccgtttggtaacagggtaacctgggcataattaggtgcttgattgacaagagagttaccagtaccagaagtcaggttctattttaaccccatcatttccaattgattgtttttctctccaccattattcactgtctctcaagtgttagcactctgagttgttgaacggaggtttgtatgctgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatctgattagtagttcagaacccaattttcagattgtctatagcaaactgtgaagaactgtgctgtcaaatagaaatagaatataagccccatatgtaatttaaacttttctaataccccattaaaaactataaaaggggaggaaatggaaaattagtaaaaaaaaaaaaaaaaaaaaa

SEQ ID NO: 13823 - DNA, 1205 bp, Homo sapiens
attatctgcttctaggttgctaaatatcaatataaagcatattattccagtaagtgccaatgcagttgttagatgctggcgctgaagttagtgctcactgcattctctcttgttggctgtctacttgagtcaccgattggcacagccagagctataaccagtctgtgaggattgatttgccctgacttgtatcttcatgtgtggtctataaggtctgccagattggcttatagtcacaaccagcatgtcctaagcaaaatgaaactatatgaacaaaaatcagctctcatttcactgctagactttggtgttttctttaagaagtagccttgttaatgcttagttttgccttgggggccttaatgtgtcattaactgcctggaaatacctttcatttaaaaaagtatactttagtacctaatgttcaatttagtatcgatctggatattttagcaaattttgacttttcaaagacaaagtttctgtcttgtaatgtttcttgggccggctatactgcctttcatctaaaactcactacagttcactgggccgtttggtaacagggtaacctgggcataattaggtgcttgattgacaagagagttaccagtaccagaagtcaggttctattttaaccccatcatttccaattgattgtttttctctccaccattattcactgtctctcaagtgttagcactctgagttgttgaacggaggtttgtatgctgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatctgattagtagttcagaacccaattttcagattgtctatagcaaactgtgaagaactgtgctgtcaagtagaaatagaatataagccacatatgtaatttaaacttttctaataccacattaaaaactataaaaggggaggaaatggaaaattagtaaaaaaaaaaaaaaaaaaaaa

SEQ ID NO: 13824 - DNA, 511 bp, Homo sapiens
ggaacaattgcatcaccccagaaaattccctttacagacagatctgtccctccaaacttagcctctggcatcctctgatctggttcctgtgactctaggcttttctgatgtttgtttgttggccttttctagggtttcctgtaaatggaatctcatgtcttctgcgtctgggtactttgacttagcatagtacttttgaaattcctccatgtattgcctgtgtcccttcttattgccgagcagtaatccactgtattcctactgtggattatgttccaccgttgtttatccgtccaccagatgatgaccgttgggttgtttccagtttttggctgccatgagtcaagttgctataaacgtgagagtgcaagtctgtgtgtgaatacacattttcatttctcttgggtgcatgtaacagtggggttgttaggtccaatggtaactgtatgcttaataagaaactacctgattcgctgagagagagctttaaaggaaaaaaaaaaaacaaaaa

SEQ ID NO: 13825 - DNA, 1067 bp, Homo sapiens
ggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaaaaaagatctatgcttggcgcagtggctcgcgcctgtaatcccagcactttgggaggctgaggcaggtggatctcgaggtcaagagatcgagaccatcatggccaacatggtgaaaccccgtctctactaaaaatacaaaaattagctgggcatggaggcgcgtgcctctagtcccagctattcgggaggctgaggcaggagaatcgctttttcccgggaggcagagattgcagtgagccgagatcgcaccactgaacttcagcctggtggcagagcgagaccccgtctcaaagaaaaaaaaaaaaa

SEQ ID NO: 13826 - DNA, 142 bp, Homo sapiens
ctgtaatctcagctacttgggaggctgaggcaggagaatggcttgaacccaggaggcggaggttgcagtgagccaagatcacaccactgcactccagcctgggtgacagagcaagactccgtctcaaaaaaaaaaaaaaaaa

SEQ ID NO: 13827 - DNA, 858 bp, Homo sapiens
ggaaaggctggggaaactcaccatccattaagcagaatgttttttggtccccctgtttttagcatggtccttcatctccacctccagctgtgtctggtgtccgtctgcaagtccaaatccttggttcaaccattccaggcaacctggccaaaactaaccaaacacccatgatctcccgagaggagaaaaggcagctgcctggccacagggctggggaagggaatcaggtcatcctgctcctttgccagacttttgatcgctccacctggatttagccctgtggcacagttgtgccttcgaagatgtgtagtgccttcatgtgctgagcttttctggggggcctgtagctttattctgttttcttcttcttagcttctcattctgtacacatttagatctcatttttctcttgtctgctttatatcttctttaattttgctgatgtctgtcagctgcatcatttcttctcccaatctctttgtgtttataggtttacacctttcattatttcttgcctgttattttagtattgtttcaagagtgaacagagggctaggcatggtggctcacgcctgtaatcccagcactttgggaagacgatgtggatggatcatttgaggtcaggagtttgagaccagcctggccaacatggtgacaccccacctctactaaaaatgcaaaaattagcgaggcatggtgatgcgcacctgtagtccccagctactcaggaagctgaggcaggagaatcgcttgaacccgagaggtggaggttgcagtgagccgagattgcgccactgcactctaggctgggcgacacaacaagactctgcctcaaaaaaacaaaaaaaaaaaaaaaaa

SEQ ID NO: 13828 - DNA, 27976 bp, Homo sapiens
tttctagaacaacaacataggcattttatttcttttcattaagcttcttagtttcttagtatcacaatggaatgatgagaaaacaacaaaaacgtgagtctttgcaaatctctgacaaagagcagagatctcaaggcaattggggcgggggaggcttgacagaagtgccagagcagttccaacgtcacatctctccttggctggaatggtgagaaggtggcactgtcgtgagctgtccttggcaattctgccccatgagccacgtgcgcctggtctgcatgggccaccccgcgggatttcctggtgcctcctagtacctggccacacacccctccgcctgctccaacgccctgggagcaccgtccagtgctcaggtggacccagaagccagctctgctgggcagcggcaagatgtggaggagcggcagaggcaggcagcgttgcttgcggtgggagaagccaaggagtgtgaccaaggcccatctgggagacatctgtggtggaaggtagggctggcgcaggtggcagcagcagaagtccgtgtccccaggcagtagcaggcctagagcttcacagtgccagggggcaggctgtcgttgcagagtctgtagtagcgcaggtcgttgaccagcctgtgcacattctgggtgaatgagggcaggtcctggaaggcaggggcatagctgcagccaacaacacaccaggtcacccacccaccagaccccaacagctacttccatcccagagtgtgcactgaagataggggagcactttctaaaactcaaaacttctattcactgttgcactgcgtgtcacagagactctgtgccaggcgctgtgggagaaaaagaacaagaggaatacgtccctagggcctctcgggtgccagacactgctgcaatcaacatacagacatcaactcactgagtcctcaccacaaggctgccaccaagccctaccagaaccactagtctaaggacagaaagaccaaagcgctgcaccatgaagaagctggccccagctcacactgaagagaccagcacacttgctcctgagtccggcccctcaaacgcagacatggctgtggtgacagccctcttcttcaccatggccccttgaggtgacgcgcacaccgagcaatgtctgcagaacctttacccacggggctccaggccgcccctgcccctcgagagccacccgagcagcagcaaacacagtcccaaggcctgtcccactgggcgcagcgtgggccatggaaggccctgggccagaagtgaggccctgacctccgccatcatgcacacggtgagaccctgctttttttttcagtgtaggtcccggtgaggactcaaacaggcccagcaagccccagcagagccatgagcaggaccaagttcattttcctgcccaaccactattcctcttccagaactccattcaaagcctgcctcttcccaaagtctgcacagatgcctcctatttcctggccccagcagccagctcagcgcctctgtcctgagcaatctgcttctggggagtgtgtgcaggctctggggccagaacacccaggtctgcctcctgcttcgcagctctaccacttccaagttctgtgaactgctcaccttctgagcccccaccatctgtgaaatgggggagtaacaggacccacacttcagaggcttgttagaaggcttactcgagccaagacatgtcacatgcttggcactatgtggtccacagagggtgctgtattggcctgtctaccatgaaagacttggtgaaggctgggactggtgccccagttcctggcccggggcttgagaagcagctggcttcaaacacacagtgcgtgactgaatggaaggtggtgattcttttattttaccctcaaaaaaccaactaagggatgtcttttaaatcagtggctcccaaatgccaaaccagaatttcctgggtagaacacagaagtctgtttctccatttttaataagtaccccaggtgcttctgatataactagatttttttttttgagacaaagtcccactctgccgcccaggctggagtgcagtggcacaacctccgctcactgcaacctctgcctcccgggttcaagagattcttgtgcctcagcctcccaagcagctgggattacaggcgtgtgccaccacacctgactaattttttttatttttagtagagacagggtttcgccatgttggccaggctggtctcaaaccccctaacctcaagtgatccgcccgccttggcctcccaaagtgctgagattacaggtgtgagacaccgcgcctggcctataactagattttgaaaccacagctttaaatcaaaaagttgactgatattgatgtcgttagaagctgatcattaagtattaggatctggcctctagaaaaaggaaaaaacatatccaggggctgaagtgaactggaagaggcttaggagagaacaagtcccaagaaaaggaagaccccaagacaaaggagaacaggatgagtctaagcaaaagcttccctgccacacgtggcaaatgaggaaagcaggcggccaggtttgcaccagtgagagcagtgtgtgcatctgagcactacggtggagccgtggacaagctgcttcacagaggactcaggtcaagaaccccaagaggaccagggagaaagcgatttcttttcctaatttcatcaagtataaaacggtacaaggaaaagttcccagaagttcctatcaggcaagagagaggcctggtcacctgacacaggaagaagagaacaggtgagccccatggggaaggaggtcccaggcactgtcaggctccaacaagatggcctcatggacaccaagagccagcagcacccagctcccaccgaggtgctgcacgggtggggacagcccacctgacagtccctgcacaggtggcagcagtgggacaagagggtgagtactaggagggctcctcccaggacctggcagcaactcagcccaagctgagctggggctggtctggaaagagcccaagacagccggggaacctgggtcccacctctaaccctggggacccagaagtgcagctcccaagcaccaaccatctcagcctgaatgcaagcctgggcacactccaatgctggccccaccggggctcatcacccaggagggagaacggcagggtcctgggtatgaacaaagatgccaagacaaatggaggggctgcagagccaggaactcgggacctccatggctgagactaagaacatacgtgctacagacaccaagactggggaaaaggctgtgcccctcaatcaggctacagcaccaggtcagcaggcatctcgtgagctgccgccaagctgcagggtgggcacagaccacgcccagaggcctcaatgtgccccctccttgctgcacaggtgccaggcttgcgtgcccactctgccctcctcttagcccggcctctttctctcctcacccgatccatcttgaaattccgccccagcacacttttctggttggcatccacaccatcacagctggtcaggaactctgggaggaaggcggcaaagaagccatcaaagtcgactgaggccatgttgtagatggcgatgccaatctcctcctgcagaagatcatgggacttgtggaccaggacctggagcagcacgttcacaaactggaacagcatggcagtccggaagatcttctgcaggcagagagaccaggtgagcagcagccagcccccaggggcctgtcccgggtcccatccactttctgtcacactctccagtgagtaacctgagggtgggacacaggccacaatgcccctgatggaagaatatttccaagagctggggcacttaccttgtggtacagcttctgcttggtgttgagagtctccaagtagaagagattttgtttaaaaaggtggatgtcgggctggagaaaggactgtccgaaagcctaggaaatgagaccaccattttataaactgcaagaccaagcacttctggagcatctaccccatgtcagaagaacaagtgccagggccagggtacccattgtcttgatgcttctggcccaccagctcagacctctacgacgctcctcctaagtctcagagttcatgttttccccaccgggccttgcttcttattatggtctcatatataccttttttaacaaacctctagaaacccatcacaggacctggctttgaagcaagaagctcacacctctagtcaaatccctcagcaatcctggcagacagacaccaaagcctgcctgcctgctcctgctcaagccaagcaatcccctcccttgccctccttcttgcatcccccgtctcaaaagccacaagccctacaggctccttcatggagcctccacctggaggttaagcctctgcctgggggctaagcaaagtatttttaaactgctttggaattcctgggtgtaaaagttactagttcagtccaggcacagaagctcagtcctgtaatcccagcactttgggaagccgaggtgggcggatcactgaagggtgggagttcaagaccagcctggccaacacggtaaaaccccatctctactaaaaatacaaaaattagccaggcgtggtggcggacgcctgtaatcacagctactcgggaggctgaggcaggagaatcacttcaatccaggaggcagagattgcagtaagctgagatcctaccactcactgcactccagcctaggcaacagagcaagacttatctcaaaaaaagaaaaaagaaaaaaattactagttcaggggcaaaaagaaacaccccgcacaccaacacaaagtgccctgctccaacagaaagaatagaaagtgaccatgggggcagtgggggaggccggtggtctgcaggacccccctacaaaacaagtggtgactgctttgtcattctgtccctgggcccctaagctaccagaggaggatcttgtaatccctgcagcagggatgagatctccatgatgaccaatagtttccacttatttactgtttaaagttaggttcatggaagtataacagagtaaacttttgaggtttatctttctatgaattctgacctacctgtggatttgtaccaccaccatcacaaccaagacaggacacttccatcacctggaacgtcccctcacaccctcacccctaaggcaaccactgctcattatctgtccctgtggttctaccttttccagaatgtcatagaatggcatgggatcctaccatgcgtagcctttggcatctagcttctttcacctgacagaatgcatgtgaaactcatctatgctgctgattgtaccaagaatccatgcttgcttattgccgagtgccagtcccttagaggcatgcacgagcctgttcatccattcagctgctggatactcaaagtgtttccagctttggcaattatgaaacagcttctataaacatcagtgtacaggttgtgtgaacatatgctttcatttatcttgggtaaaatacttagaagtgagactgctaggtcatacagtaactacacacttaactttaaaagaaactgccaaactgtgaaactattctccaaagtgcctttcaccagccctcagtggggaccaggcaccagcgtgccaaagaagtcttccaggcaaggacagggttcaagagaaaggcaggggaggtgcaaacacttgagtactgcagacctgaggcctcggtgggtgccagggatgggaaggccagggcaagggcacgtgcctgaaaagaactgccacacaagagtcagtatgtgtgtgtgtgcgcgcgcatgcgcacgtgcatgcctgtgtgcatgctgtgtgctagtagggagctggagggagggtggaaatccctcttgcttccccatgaggaaaagcatgcactgaaaataccaaaagagactcccctagctagactcagatgagaacgtcagacacttgagtgcagaccctgggagcgtgcctgacacagccacagagcaggctggctgtctgggcgaggtgatgccgtcccagtcttccacagcaaggggtatttagcccccagacagtgcactctctccaatggacagctgcatctgccctgaaagcgaatgctccctcccagggcagtgtttctcccagtatggtcagagtcagaatcacagtgcaggtctggggccctcctgcggagactcatattcaggcagctccccgctaagaaggccctcggtgactctggcataggcaggctctttacacttggggaaacagcactatgaggtcagcggaactgacgtttatcaagcatctctaagtgtcatgcactttgtgtatgtcatctcatttaacctcacaacaaacctgtgacccaggcaacattagctccactttgcagatgaagaaactgaggctccaagaaattaattaacttcatcaatactaacaggcagaactgagcttcagacccgagactgtggggcttcgaagacaggactcgctgcagtggtcaggttagaggaagtcacctggcagcaaccccgcccccacgttacctgcatgatggcactgaactggggctcattctccatctgctcctcagcgatccccctctggacactggccagcacggtggacttgaagaagtacctccagttgtgatggagcgtccggaaaaggagctcaaacagctcggccttcacatcaggggagggacgctgcaaagacacacagacgctcagacctgcagcttgcggagctgctccggcctgggcccagggcagcaaagatgcctaggagacgcctcgtgacagcaagccgagtgtcaacactccatccacatgcctgtcactacctgcgcaaaagacatccagcccctggagtcctgtcactgcctgtgcaaaagacatctagcccctggagttggcggttcacaccgcgagttcttcaggagagacatggcccacatttgagagagaatgcacgggtcagtgccaagggcccctttttctgatgagcactcagcttttacactagaaaaaagataccaagtggatgaacaattaggagtatggatttcctgttctattcgacctgtcagatcttcttgcttgttccttttcccaggataaaaaatgctgtcccactaacctgttggtcttacacaaccacggaggctaaagacagacccaacgccttaaagcgattctgctccccagaaggggagggtttaaagaacacttgggagccaggctctctgggccagtctcctctttcccagtagccaggattctgagaggagttagaggagaagggtcaggctcagcagtgttttctcattgactccaactcccccaatcccttattccaaatgtctctgcagaattcaaaattagaaggcccacatatattcagttcagccttgattaaaattaaatagacaccaggggccacaagcatccacagaagaagcctcataggcccagtgcatttcgtaatgcacagcaaccagacctgtcccagtctcagttcagacagttaaagattaactcttatttatacgactattaccaaaaaaactgaaattaaatctatacttattccgggtcttattatgctgagtgcctgcctattttctaagaaggacaaagggctttcctgtaacactgaaaggtttgtttgaatggtttcaagaacttgccttgtatcctcgagaccatgaatgtttctaataggaaagtacatatgttagaatgtttgctatagaaaaccagagtctcttaaaggtataaaatttgccacaggagactgatcttagcaactgaccctgtggaataactgccatgcttacactagactagctccaatgaactcaatcaatataaaaacactgtaccacaccactaaaggccttcttccttgggagaaactactttacaagcatattaaactaacaaatgaactttaaaacacaatacattttctgtgaaatctcattcccttcccaatctggagatggggggtgctgcacaggggaccgtctgagcccctacctcggcaatgatgggatacacttgctccatgcacagggcgatgatgctggggaggaagggcttgaacacctggcctggctcctggaccaccacctgcaggatcttcagaaacttctccaccacccggcagcctgtgctgccctcgtggaggatgctctcggctaactgctctctacagaggagaaagccacacagtgagcaaccacatgtttctctgggggccagcatgaaaacccatgctgtggcaagtgcagaacaggagcaaaaagccacactttgtcgccagacccaccacttctcccttgaatctgaaaactatagatggtgggtctgtgcttacctggtaaacatgttgaggaaagtctgtatgatttgctcagtgaaaggcacacccatctgtactctaaggcctcgaaacagagtgaggaagaagctcagcatctcatcagtcacatctgaggaaaggggcagagatatcgtcagaggcttgcacacagtgagaaccagaaccctgggcttcatcaacctactcctgaaatctgcactatcagctttctctacagcttcctgctggaaacatttccccaacaccatcagggccaatgatggaaagtggaaaacgattagggacatgctgagaaaatagttctggtatagggaacctccacctggtggctcactacaggaaatgaaggtcatctcgaaccctccctcattgcccgacatccagtgatggtcagagtttcactggagagggatcactttgtgcccacactgatgaatgccaactgggtcaacacctgagtgcttaagccatttccccctatgactaataatccctgcagctgggtcaggggttaagtggttgaaagtggataatgaaggtgtatttaggttgcatggccctggtccattaaatggattaattgcagaaaatactggttacatatagggcagtttcacttccagatctcaacaatcatcttgtgtagtgtgtttcagccctaactgcacgcaatctgcttgcaagaggcaatgaatatttgctgactgagaagtgcctgatatttctcttgtaaaactgacaagactactataatgctgtcatgagagctaggcaagtacatccacagagctagagaggccctctatcactgacagtgacagacaagggtgaggggaacgatctcggcaaatgcaccttgccacaaaataaggagaactaagccaaaaaagctctcttgccttctcttgtaggtgccaaggcccatatggagagctctgctcacttttccaaagggccttggccctagactccacaaataaacatcactgccctttcccctcagtaccgggtttcgttgcacggaacaagtcaaggcctgtactgcaccgactcagtgtgttctacagatctaagtgggtattctggcccttgttagcaccacccaccagtggggcctctgggccagctcctacctgactgatggataaaagctggaaagagggccagggagacctgaacagattcctgcagcgactggtagcaaatctgtcgagacttggtggactcccccgagatattctccacaatatcttctaagacgctgagtgtctggtggataatcagtttggctgcaaatcaagatgagttgcaggttataagctgtctggggagaaagcatggtaagaggagacacaagggagagggaggaaacttgcaaaggtaccaagaagatgatcacacgagtctcactaaaggaacagtctcttgattacaatataaattctcctctctttatgttttagtttttgtttttactattattactgccaggactccagaagcctggaatgtgtgttggggagaagatgcctgcctgcctgcttgctcaggtttttgcctctgttttgcctctggccattggcaacaagtccacagaagaaaaaagataaataaatgtacccccaggttgggtgccttggatttaatcaaatctaaaagatggtgaatagactggtgagaaaatgagtgtcataaggtcacaggccaggacggacacatgcagctcaaaccttgtcactcagtgggatgctactccagcccagtaatcccacaaacacctgccatgcacatgtaatggtgctggctgcaagaacaacctgcctgatccatctttggcctattagccctgtagcttgataaggcatataattactgttattatgttattgacaatacataatgctaaccctgagatgacttttgactccatatggcacacagggaaaacagatgtagtgggccgcaaacaggcagaggtcagagagccctggctatgaaccacaggtgaccatctgaaggctatgtgccatgggcaggaccctcatccatctgggagagccgacaaccccactctggcagtgctgcagtggggattagagacaaggtcccgaacgatgctagcagtgtgccagccatctaagaaggtccaggacggagatgctgccattgttcccagcgcgagtggagtcaccctcttaagatgcagagtttcccaccagcctccccaaagtgacgcccatggctcagcctgagcctagcagactcaaccctggtgaccaccagaggctgagccagagctgggctgagagctgcctcccacttggcagcagtctctgggtcccccgaaccccagtgctcagcagcctctgtgggactgccgcagctttgaggaaggggtacggcagaaagaagacatgctcaggaggcagatggaggcaggcctggccctgctgcccctcatctgaaaacgtggatagagagcatcgccccactcacagggctgaggatgaaggaagacgcttctcgccacaggcctggtcctggtcccccagtcacagtgacactggagagtaaaggaaaggctcacccacactgctgagcagggagccgtccacaactacaagcacatggacttctactcagctaggaaactgcactcagggcagccacttcctcaagaacgcacaggcaacaggggaagcagtttagagcaaaaaaccaacagtcaagagaccaaaatctgacctctggcatttaaggaaattcaaacgaggacaaaagatgtatttaaaaaaaatacaagtcaaaaattgaaagcactataagtatataataataggagaatggggtgggtaactgttatacttccatgagacaggacattataaaaccattaaaaccttttttcttttcttttttttttttttgttttcaagaagaaagaagcaatgcagcaaagtggtgcagaacacaggagctggagccattcagacccaagtccaactcttgacctcgcccactttctctacagtcctgagcaattacacctgccaagcaccttcccaatggacagactggcaggccctactcccaacaggcatccagactgagcatcaccaaggatgggacaaacagaagcaatgcaagaggaaatgcgaacacgaacatgcaccactacaccacaacctatggaaacaatcaggcaaaacaagactaggagacatatgacaagaaaacaggcctggacgcttcaaaaatgccaatgtcacgaaagacaaaaactgggcatgctcttctggatcaaaggagactaaagagatataacaaccaaacacaataaaactatcctagattacatcctggattttttaaaagcaaaaaagaacaatttggtaacaactggggaaagtgttaatgtggctacattttaaataacattattgtaccaatgtttaatatcttgttctatatagatacaaaggttaagtagtcagagatgaagtgtcaattatctgcaacttaaacagctggcttttaagaaaaagtgtgttgcagaaaaaagcataaatgtggcaaaacattcacaattagtgaatctgggtgagagagatgcagttgttcattttcttattcctttggctagtctgtaggtttggaatttttttttttcaaagtataaagttgagataagaaaaatgaaactttccaaccttaatttcaacactgtggaatgaggataagacatacctcacagggttacagggttacacaggaagttacatgaaataacgtatacaaagtgctcaacccagtgcctgcacacagtcagcatactgaagacgtcattcacatactacactgcaaaccctttcagcacacagtggcatcacacctccctgccctctgagttaagccaaggccatgtagctggctctggccaaggaaatagaggtggaagtagtgttagtttcaggcaagacctttaagaaccactacgcaattcaccacaatcccttccagagtgaacacactgaaatggagccttccacagcctgggtccctatgtgacctccccactctgctgacccatgctggacatatagtacaaacaacatatcctttttcttcttgtattaagccactacacttttggagttgtttgttaccactgagcatatcctcgcccatgcagaccaacataactcccatgtaagataaagtgcggaaaggagaccattacacgtgataaagcatgactccacaacagctggatgcaagccctgggcaagttccttaatcttctagacctcagcttcctcatgctaatcatcaatcaagatcctaacagtaccgaactcataaggctaatgtaagaactgaatgaattactgatttttgaaaaatacttagaaccaggaagagaccaacaccagactttgaaagttgatactggcatagccagagacttgacgatggatatagaatcaccaaggcaagagcctagtacacagtataccctcaatatgtcagctactctcatccagctatgtaaccatgaagcatattttaaaatagaaaagggaaggtaagaaggaagcatggttaaaatggttactttctaaaatattaaaactggtcagatttaggagttactttttccttctttgtattattctattttaatgtatttgtacaatgcacatatgttaatcttcctagttataaaagtagtgttttttaaagagtatagtatttattactatttctgacatttcacaaagcatttttgctgacattccataaatggcaccatctaataatgttctattattttctttttgtgaaaggagctcgtatttttaaaatatttcggtactatttgttatttcaaagagatatttccttattcatttttttccctctttctttaatataaacaagcaaacttcaagtgccattttttaagaaactaagctctttcaaaacctctggaagatctgtatttggaaaaaggttgaaaccaatctggaaaaatagttcttgagcgcattttcccagcgtgtagaggtgaactgctttgtttgcctacacaagcatctgaaatagatcaataaccaccttaagatgtattttatagacagaaggcaccatcaccagtgtcttccattttttcttagggctccagcattttttacattttaaataagagaagggacagtttgattctggaaataggtctggctgctgtcttaactgaattccaaaggtagcaggatcccacccccaagtatgacttcctgctcagcctctgtgggactatgaacaaaaaaaatttacctcaggagcctccggggcaaatctcatctgccacaaagaacaatgcctgcctacctccttccccagctgtcctagcctaggggtcacttactgtcatccagtggcatctttctctgtggggcaacagcactgggcttcaggttgcgatagtcccgggagagtgcagagatgaggctggcgtggttgatggagcgcacgggccactgctgctcattctctggaaggtttggccacggaagcagcaagatgttagagagggctcggcacaccaacacctgggcctacaagagaccccaaaggcatccatcagaggtcagagccaaagaccgtggtgcggcatgcccaacacagccttcagcacccgctggctgcacacctggaaccctagcccccaggctcgtttcttgcaacctgggcaaggcctttggtccaactggaaggcagcttagggaggaagatgaaatgaagtaatagcaccatgtctaggtctagcataacccagagctaacctctcgtttcctctgtaatctgatacttgaagtattagagagggaaaaatcacactgcagacactgaatctcaggcattgttcagctggtggcttctgagtcctctgagaagctacttagagcaggacttgcaggagaatccgtgacaatccatgcccctagcaccaggtcacatcctgcaatcgcatcctggtgccctctggtaccctcttcaaaccttcctgccctccctcctgttaggtggtttttaaacttctagcttgagcctcctttgaggattctaagaaaatgcacttgcctggcacttctcaaccccaaagaacacacacagaacagtgacaacaaaaaccagactgctttgaatcagaaagaatgcaaagagaattctcacaacactggccgaaattaccaggctgcaaagcagcaaaacctttctgcacactgggaggtgcttttccacgcctcaatcagcacactgactgcctgccttagaatgggcacgatgagaatcactgagtctgtgtcagtgccacacaataagaaatctgtctatgctggtacagcctgtaagctctgagtacaaaatcaaaggccagactcttcttcctcagcttccttgggtctcagtcacacagccctggggaccccgggggagctctggggcctcaccttatcgacaagtcgcagggcagaggcatcagtgattctgttgaatactttctgcactgcagggatgctgatcagaaagacgggccgcacggtggtggccagtgagaccagtaagtggcacgcagatagcagcagcttgtcttggacctgcagagggaagagggcacgtcagctcaccacatccctgtaagactgggattcgaactttgctgaggcagccacaagctatgtgtcattcttggtttccaaattacaccacctaggccctatctagctcaagaatttttcctatgatgactacaagagaagcccatcttctctgtcatgtccacagctcctgccgcagccattatcacctcctcccgttcctccttcacagtcaccagcagccttgaactcaggcacttctcagcttagagtctgcagtggctccctatcagctattaaatcacactccctggcatgtcatccaggtcctagaattcttcacctcactaattgttccagcagagccaagatctccccgagcccccgactcttctgtgccttaacactcaggccagtctctcctactgctttcccttcagcatgcctatcaaatacttggttcaattaccactgttgctttcaaattagcaaaggagaaaaacgtgttacagatgggacctaatgctggtaagactaagataaaaacagcacaccaaaaagtcaaggcaggcagaattacttcgggaaaaaaattactatgatttcccaaagtcacaaaatattcctaacctttaacccttactctaagattacctataacctataatacttactctaagaagattacctaaaagggtaaagctacattcatgaatgtgtgcatttcagaattctttataataattttttattttttaagggaggcagcctagaagtccagcaatggctaggaaaataatgaaacatattcctgatgggataggactattttcaaagttataattataaatacaacataaatttatggaaagcaacacattgttattaaaacaatacactgtttaaaaatgtataaaatgttatgtatgactaaaactacaaaaaaattcaaagaataaacacatatatgctctagtaatatagcagacttggaggataacataatagaatctgtccagttttaacatggatataacctttgactcagtaattccacttccaggaatctatccttcaggcccactagcatatgtaagatggacataaaaggaactcatttctagcaataggaaaattattatacatcctcacaaaaaaaaaaaaaaaaaaccactggacattttgacaatctgaagttgctgtacatatgtaaaggaaaatgaaggcatactgttaggcaaaagcagctatatctccagctatctacaaacttagttattacttattacataaaaagagaaaaaagtctggaaggatatacaggcatacctcagagatactgcaggttcagctccagaccaccacaataaagcaaattatgcaataacgcaaggcacactaatttttttgtttcccaatgcatatgttttgtttacactatagtctataaagtgtgcaataagcattatgtctaagaaaacaatgtacatatcttagttaaaaagtagtttattgctaaaaatgctaacaatcatctgagccttcagagcggtaatctttttgctggtgaagggtcttccttgaaagtgactgctgctgactgaacagggtggtggttgctcaaagttggggtggctgtggcaattacttaaaataagacaacaatgaagtttgctgcatcgattgacttcctttcatgaaatatttctctggagcatgcggtgccgtttcatagcattttgcccacagtagaacttctttcaaagttggagtcagtcctctcaaaccctgctgctgcttcatcaactgagtttatgtgttattctaatcctctgttatttcaacaatgttcacagcatcttcaccagttgattccatctcaaaaacccactttctttggtcatttacaagaagcaagtccccatctgttcaagcttgatcctgagattgcagcaattccatcccatcttcagactccgcctctagttctcctgttatttccacatctgcagttactttctttactgaagtcctgaaccccttaaagtcatctatgaggctgggaaccaacttcttccaaactcccattaatgctgatattttgatctgcttccatgaatcatgaatgtctttaatggcatctagaatggtgaatccttcccagaaggttttcagtttatttgcccagatccactggaggaaccaccatctatggcagctatagtcttatgaaacgtatttctgaaacaataagacttgaaagccaaaattaccccttgacccatgggctacagaactacagaatggatgttgtgtgagcagccatggaaactatggaaactaatatctttgaacatctccatctgagtccttaggtaaccaggtgcattgccaatcagcagattttgaaaggaatctttttttctgagcaggtctccataatgagcttaaaatattcagtaaaccatgatgtaaacagatgtgctgtcattcaggctttgttgttccatttatagagacaggcaaagtagattcagcataattcctaagggccctaggattttcagaatgatacatgagcactggcttcaacctgaagtctccagttgcagttgccccctgacaagagagttggcctgtcctctgaagccaggcactgactcctcctctctggctatccaagtcccagatggcaccttcttccagtataaagctgtctcatctacacagaaaatctgttgtttagtatggccaccttcagcagtgatctagaacttctggagaacttgctgcagcttctccatcagcacttgctgcttcatcctggagatggcttctttccttaaacctcatgaaccaacctgtgttagcttccaactcttcttctgtagcttcctcacctctctcagccttcacagaattgaagggcctgatctggatttggctttggcttaagggaatgttgtggctagcttggtctatccaaaccactgaaaccttcctcatatcaacaacaaggctgttgtactttctcatcactcatgtgttcactgaagcagaaattttaatctcctccaagaacttttcctttgcattcacaacttggctgtttggctcaagagcctttggccaggccgggcgcggtggctcacgcccgtaatcccagcactttgggaggccaaggcgggcagatcatgaggtcaggagatcaagaccatcctggctaacatggtgaaaccccgtctctacaaaaaatacaaaaaaattagccaggcaaggcggcaggcgccagtagtcccagctactcaagaggctgaggcaggagaatggcgtgaacccgggagacggagcttgcagtgagccaagatcacgccactgcactccagcccgggcgacagagcgagactccatctcaacaacaacaaaaacgacaaaaaaaaaaaaaaaagagcctttggcctatcctggcttttgacacgccttcctcactaagcttaatcatttctagatttttatttaaagtaagagacatgtgactcttcctttcactcgaacacgtaaaggtcattgtagggttattaaatggctcagggaatagggaggcctaaagacaggaagatggggaagcctccaatcagtggagcagtcagaacacacacatttatcaatcaagtttgcagtctttggtttgtggcactccaaaataattacaatagtaacattaaagatcactgatcacaaatcgctgtaagatatagtaacaaaaaagtctgaaatattctaacaattaccaaaatgtaacacatggaagcaccaaatactgtcaaaaaaatggtgctgacagatttgcttgatgcagggttgccataagccttcaacttgtaaaaaacacagtctctgtgaagcgcaataaagggaagtgcaataaaatgaggtgtgcctgcacaaccactgcccaactgtgcttaccgcgcgaaggaaaatgtttcagaggtatcacaactttttagtctggaaatctgaatgatattttactttttcacagtgagcatgtattcatgtggaactcagataactaaaaaagtaaagttgtatctgaatgcatgtaggctacaactaaaaaggaacatgaaataaaacagatgtataacagcagaaagatttatgggtctaactctgtgtcatatttagattttctagtaaatgggtataggaacagaaggagagacagagagttagataaaaggtgtaggctttgctgtttcgagaccttggtgctgattagaggtgtgattgcatccatggtagtagagatgagtgtcacgaactgctgcgtgttctgccggtgaacttcactgcaatactgtgctaaccagtgagagtaagcctgcagcgcagccagggactgagcatgcctgcagaaagaaaagaagatgtgattttaaaggttaaggtgaaaatatattagcgttcaactcattttcataggaggtaagaattgcatccactgcatttgctgttctaagacatgggcaacagcatagaaatcatttaccggttcacgtagaacctaaaaactaagatattcatcatctaaacattgccaccgctgactagagcacagaaggcagttagtcaatgtctactgaatcttattcaatctttctgtgacacatgctcacctaagagaaaggtaaattataaaagcaaaatcaaagaacttaagtgatcatgtgttgacttcagaactagtacaaatttaacattcctagctgcagactaaagcgtagacaactaccaggtgtgacagctttataaacagagctttgatgtcagattttggagtttaagcttccactgcaccacacattccacctggctagggaataactgaggcggcaaagactatgtttggtttcagcaaaggctgtactgactgcatcgtacatgcaacaaaatatacatcaaaaaagtatgcaattcatcaaatataataaacaatcaatcttaaacaaggagagacagttgtctcggagcttcaaaacaccaagccttccaacatacctaaatgtaattacctttcggtaataattagtaagttgtaaggtggtactactatgaggtgacacaaagacagtgttcctcatggtttgggcatttattaacgactcctgcctaaatcagtattacattggtggttgtgaattggtaatttttctatctttccttttctcctcattagttggcagtcttctctaaaaagaggctttccctcctctcatccttattttgttaatcactttgggtttttgtttatctgtttgtttacttgagacagggtcatattctgttgctcaggctggcatgcaggggcacgatcatggctcactgcagcctcaaccttctgggctcaagtgattctcctgcttcagcctcccaagtagctgggattacaggtccatgccaccatgccaggctaattgtcgtattttttgtagaaatggggtctatgttggccaggctggtctcaaactcctgacttcaagcgatccttctgccttggcctcccaaagggctgggattgcaggtgtgaggcactgcaccggcctagcctgttaatcactttgaatgagtagattattttcattcaaactggtataattcattattgtccttattctttcttgatgactgaactgtcaagtttgaccaggaagaaccctttcaagctgggtcctgcatcctcttcacatgttcccaacagtcactgagcacttccttacttgctgacttggcaagattgtccaacatcacccccccagacttgagcttttttctccaaggtgctctggagaatggatttgagaaaccaagacctggggaaaagggataggattgctactggattgtcactgtttctaggagctttcagcagacagaattaggatataggcaggtatcactttatttacttatttatgttgctgaaacagggtctcgctctgttgcccaggcaggagtgcagtggcacaatcatagctcactgcagcctccaactcctgggctcaagcaattctcctggcttgcaattctaagtggctggggccacaggcatgcaccactatgtccggctatttttttttttttttttggtagggacagagtctcactatgttgcccaggctcctctcaaactcctgggctcaagcgatcttcccacctcaacctcccaaagtgctgggattacaaacatgagccagtgtgtccagcctagacaccattttaaaagcaaactcagcatcaacaattacagggaaatttgatattaagagccttctgacatgatgcaagaggaaaggcacatcattgcctatgtagtaaccttgctaaaaatgtttaaactgaatctaatacaatggaaataattagacaaatccagattgtaggacatgcttttaaaaaaattaagatctggatctgcaaaaggtcctcagtcactctcacacacacacgcacatgcagacatacaaacacaattgggtgaactgttctagactataggaaatacatttaatgtgtggctcatgattagttagaacttggatccaagaaaaaaaaaagatacaaaaacattcctgggacaactgaagaaattttaatatggactatatatgagatgacattattgtatgtattaaattatgtgagggttgataatgatatcatagttaaagagctgaatgaacttatttctaggatacacacactgaaggatttacgggtgaagtgacatgttgtctgtaatttcttttctttcttttcttttttgagacagggtctcactctgtcacccaggctggagagcagtggtgtgatctcagcctcccgggttcaagcgactctcccagctcagcctcccgagtagttgggactacaggtgcaagtgccaccatgcccggctaatttttatattttttggtagagacagggtttcaccacgttggtcaggctggacttgaactcctgacctcaagtgatccgcctgcctcggcctcccaaaatgctgggattacaggtatgaatcatcacgttcagccatgcagtttattttcaaatggctcagcaaaataataataataatcatcatcatcatcatcatgtattgtgtgcagagagggcacaagaaacaaaagccaatttgtaattggttactctaggctaagggtccatgggtgcttattcgcctgtttttcccattttctataggtttgaactttttcaaaattagcagttgggtaagaaaatgtgctagtactttaaagtaagaaaatatagttactgaaagtttgaaattcatagtgaccacacagttattttgtattttacatttaaaattttattttatatttagaatcacattaccctttaagttctaaataccaaaataaagagaaaggacatcaaagtcagccttaggagtaagaatttcagtcaatctagcacatctgtagagctcctcaaggctgaaaggaggggctctgaaactcccaaaatgtgtacaagttgttgtatttataaggaaactggcatctttcttgggagatgctttacaactttctctaaattctcaaaagggaaagcaatatattttttaaaagtttaaaaccaccatagtaagtaagattctctttccatcgtttatctaatctgcagctcaagaatgctctacagcaggagtcggcagaccttttctgtaaaaacccgagtgtatatattttcagatttgcagggcatacatacacactgtcacagctactctactctgctgctatagtgcaaaaccactcccagaccgtatgtaaatcaatgtagctgtgtttcaataaaactttatttacaaaagcagtcagtaagccagatttggcaaaggccatagtttgccaaccccctgctctcatctaaagcaagtcttctgggcagtgaaatctctgggatactgcccatctcctgtccctgtccttccatatgtcactttcctaacagcatcccatgttatctgtagagtttctgtaggtagagagtgtggtctctagatgtcctgcttcaaaataacctggggttcttgtttaatacgcaaatacccaagccttatggccttatgccattctgctaaaatcagaatctctgagaaacgtgttccccaagcattcttctgcatcctacagtatcctacagttttagtcaatgatctacaggaaagactgatggcatctgaggtgtttcccattagtcccaacacacctatccagtctcttcttgcactacatggagtagccacctcctgcctgtgtgactgtctcagcctgtactgttctttcctcctgaaatgcctactccatagaatctccatcccagctctcacttacctaattccactttctccaaccgcctctgccccagacatatagtcaaaaaaatctctctctctttctaggtttgcagtttaagagtttttccctgattcatggcagccactactgttcctttttctcaatcaaattatttggagattgggggcaaggtctttcctaaaaatgcacaaacatcaaactctagacttacacatcaatgaggtcaggtttcaatactgatggcacagcagtttcaatgttgtacaattttatctgagatccgtacagagtgactttgaccaacctgttggcaaagaggcaggtaaacaagaacattcagcttatgaactaagacagacaaaacagacaaggctggtaccagcaaagagcgtaagggcagactttttcatatacaaaaaagaatcaagaccagactttcaattttatgccaaggaaataatctgagatatgcataaagatttatatacaagcatattaactaaagccttattgaaggtgtcaaaaactttgaaaacaatataaatatccaacccagaggaggtaatacaatgcaatatatacaataaaaaccatgcttagaggcatatttaatgataaatattcaggatgttttaaacatgacatggttgtactaaatatacatacagaatacatcgtgaatgttcatctattaacagaagacaggcgggaagaagtgtcaccaaaatatgcttattggtaccacttgttttagggggaggatagagtgggtagattatggatgatttttttccctctatttttctgcatttccaaattatctacaattaatatataatgttttataaatgaggagaataaaaaatagttcttaaaaagcaggcagaatgtggttgctcatgcctgtaatcccagcactttgggaggccaaggtgggaggatcacttgagtccaggagttcaagaccagcctggacaacaaagtaggaccctgtcttttaaaattttatccagatgtggtggcacatgcctgtagtctcagctacttgggagaggctaagtagggaggactgcttgagcccaggaggttgaggatggactaagccaggatcatgccattgcactccagcctgggtaacagaacaagaccaaaatcctgtttgtttgttttgttttgttttgttttaaaaaaaaaactgctcttttggcagtttatcgaaataggatgacgtgggcttttctataaaatttgataatgataaaaccatcttagcttttatttaaaatcatttttaaaaggaaatgtttcagatgggttgatacataataaaaaaaatacagcaaactgtccaccatagaatctatgtggtgggtatatgtgtattccctgtacaattctttcaacttttcttcaaatttgaaaatgtttgataaaactttggaggaggcagatgaaaggagcaaatgtttctagaataggtggaggtgttttatgttcaagtacaattctttcagaagcaagctgttgagcccactggttgctcaagggctcactggatactaacgagcattaaacacaataactaatagctctatctagtaggaaatgggaaatgcctctttcattacagacaggacaacattcctttctctcctcttttttttgagaaagcgtcttgctctgtcaaccaggccagaggattgtagtgatcttggctcactgcagcctagacttctggggctcaagtgatcctcccgcctcagcgccccctcccatagcggggactacaggcgcatgccaccacacccagctaaatttttttgtctttttagtagagacaggtttcgtcatgttgtccaggttggtcttgaactcctggactcaagcgatctgctcacctcagcctcccaaagtgctgggattacaggtgagccaccacgcctggagttgaaagacattcctttctgagtgaaggggaaaaaacccaagacctggctagtttctctctgcctactctgcgtggaaacctggaaatggatgccagggaaggcagtgtttgtctttgtcccagcataacaatcaactaaggaacttgttacaaatacaaacttgtatttgtatttctgattgctggggagcaatgagaaagcaatcaaaaaggagcacttccggtcagtcaagaaagtgagggcaaaagaactaaggttcccaaagtcccacgaagtcctcgtgatcagaacagttattatcagaaaacaatataccaatatgcacctggtgtttaaatcctgttctacactaaaaatgcatttccaaacatcttttaatgtgtctgtgtttagcagttctaatattagctttgttttatgtaaccaataaatgaaaacactgctaatcatactggctattaaggtcatgtagtcataacaagagccttctctcacattttattctaaatgaagacaaaatattaataacaagtatgtttaagcactgggcttggaaatctaagcagtgcagaaagatagggacctatcaaatgattcaggatctttgagacatcatctcactacaaagttgagatgactgacagatataccttttttttttttttttgagacggagtttcactcttgttgcccaggctggagtgcactggcgcgatctcagctcactgcaacctccgcctcccaggttcaagcgattctcctgtctcagcctcctgagtatctgggattacaggcgcatgtccccacgcccggctaatttttgtatttttagtagagatggggtttcatcatattggttaggctggtcttgaactcctgacctcaggtgatctgcccgcctcagcctcccaaagtgttgggattacgggcgtgagccactgcgccccgccaactgaacagataagatatatctatattgcttaacagagtaagttcaaataatggacttatctttggatttcagacagaaaaacatgtcttatccctgctaaacctcagtgcaaatgggcccagtacaagaagaggaggaggaacggactggcaatacaaacgctacggtttggaaagcgcacaacatgtggacccaggaaactgttaaaatccactctccctctcaaagactgtgtgaaccgaggcaaggcactcacatcactgagccacaatgtacttactcaacaataaaacggcaatgcctgtctctcaaagtacagaacaaaatgaaagaccatgtgcaaaaacacagaaaatgtcctactactgtgtgctgtttttattattaatatgaatctggcttttaagggatttaagccccttggctatctttgcttttcagctaagatgtggcagtgaagtctggcatgcatgcacccaggctcctgaggctcacttcccctctgcacgtcaccagtgatgcggctgctgggccagtcgaagcatcaggtgtcttggctttgggctggatccacatctactcagttttgatctaaccaattcaacagctgccttgaaatgatctaaatgtcctgtcacttacatcttgggtttttcgaggggagaaagggaggagggactgctgactgagtagaatcaagtgttcctcaacaagtgcatctgtaaacctggtgtgagacccaagaggaaggagaagaaaaggagcccagtggtgaaaggctgggaaccacctttcgggccaggcgtggaggctacccagctttcactcccgaggccctaatgggactggaaaaaacacaaaaagcaccctgtgcatctagctgcctacttggacaatggagttgactccttatcagtagggctttcttaatatctctttatcctatgaggaaagacatgaagactgacctctcctggtttctcctgggtctacaactgtgtttacatttatacacaagatcttcaaagaaacaataccttaaataacttatcaggcgttttgttatgtgctaggcacagtgctaagtgctttatctcatttaattctcacactaaacctacaggaaacaacatctacttcatattgtaaatgagggacctgaagttcagagaggttaagtaatttgttccctatcagcttgtatgtggcagagcctagatttacccggggccagagcagaagctatttggcaatatgctgcccctcacacaagaaggtaaagctgaactctgaagaaggaacagctccataaggtaactgccagcctacctttccacgactgtgagggcatcattgaaccgtgcagcaaacacatccccgataaagtactcggccaggcggcccacggcctgcagcagggagctcaagtctctcagggagcagtgcagccgccggcagtcgttctccgccgtgatgttcaacctgtgtcctggaacacaacacgccagacagtttttcacaggaagaccacgctttagatactacagataacagctggtccagcaagccacacacagcaaaaccagcag

SEQ ID NO: 13829 - DNA, 9702 bp, Homo sapiens
tttctagaacaacaacataggcattttatttcttttcattaagcttcttagtttcttagtatcacaatggaatgatgagaaaacaacaaaaacgtgagtctttgcaaatctctgacaaagagcagagatctcaaggcaattggggcgggggaggcttgacagaagtgccagagcagttccaacgtcacatctctccttggctggaatggtgagaaggtggcactgtcgtgagctgtccttggcaattctgccccatgagccacgtgcgcctggtctgcatgggccaccccgcgggatttcctggtgcctcctagtacctggccacacacccctccgcctgctccaacgccctgggagcaccgtccagtgctcaggtggacccagaagccagctctgctgggcagcggcaagatgtggaggagcggcagaggcaggcagcgttgcttgcggtgggagaagccaaggagtgtgaccaaggcccatctgggagacatctgtggtggaaggtagggctggcgcaggtggcagcagcagaagtccgtgtccccaggcagtagcaggcctagagcttcacagtgccagggggcaggctgtcgttgcagagtctgtagtagcgcaggtcgttgaccagcctgtgcacattctgggtgaatgagggcaggtcctggaaggcaggggcatagctgcagccaacaacacaccaggtcacccacccaccagaccccaacagctacttccatcccagagtgtgcactgaagataggggagcactttctaaaactcaaaacttctattcactgttgcactgcgtgtcacagagactctgtgccaggcgctgtgggagaaaaagaacaagaggaatacgtccctagggcctctcgggtgccagacactgctgcaatcaacatacagacatcaactcactgagtcctcaccacaaggctgccaccaagccctaccagaaccactagtctaaggacagaaagaccaaagcgctgcaccatgaagaagctggccccagctcacactgaagagaccagcacacttgctcctgagtccggcccctcaaacgcagacatggctgtggtgacagccctcttcttcaccatggccccttgaggtgacgcgcacaccgagcaatgtctgcagaacctttacccacggggctccaggccgcccctgcccctcgagagccacccgagcagcagcaaacacagtcccaaggcctgtcccactgggcgcagcgtgggccatggaaggccctgggccagaagtgaggccctgacctccgccatcatgcacacggtgagaccctgctttttttttcagtgtaggtcccggtgaggactcaaacaggcccagcaagccccagcagagccatgagcaggaccaagttcattttcctgcccaaccactattcctcttccagaactccattcaaagcctgcctcttcccaaagtctgcacagatgcctcctatttcctggccccagcagccagctcagcgcctctgtcctgagcaatctgcttctggggagtgtgtgcaggctctggggccagaacacccaggtctgcctcctgcttcgcagctctaccacttccaagttctgtgaactgctcaccttctgagcccccaccatctgtgaaatgggggagtaacaggacccacacttcagaggcttgttagaaggcttactcgagccaagacatgtcacatgcttggcactatgtggtccacagagggtgctgtattggcctgtctaccatgaaagacttggtgaaggctgggactggtgccccagttcctggcccggggcttgagaagcagctggcttcaaacacacagtgcgtgactgaatggaaggtggtgattcttttattttaccctcaaaaaaccaactaagggatgtcttttaaatcagtggctcccaaatgccaaaccagaatttcctgggtagaacacagaagtctgtttctccatttttaataagtaccccaggtgcttctgatataactagatttttttttttgagacaaagtcccactctgccgcccaggctggagtgcagtggcacaacctccgctcactgcaacctctgcctcccgggttcaagagattcttgtgcctcagcctcccaagcagctgggattacaggcgtgtgccaccacacctgactaattttttttatttttagtagagacagggtttcgccatgttggccaggctggtctcaaaccccctaacctcaagtgatccgcccgccttggcctcccaaagtgctgagattacaggtgtgagacaccgcgcctggcctataactagattttgaaaccacagctttaaatcaaaaagttgactgatattgatgtcgttagaagctgatcattaagtattaggatctggcctctagaaaaaggaaaaaacatatccaggggctgaagtgaactggaagaggcttaggagagaacaagtcccaagaaaaggaagaccccaagacaaaggagaacaggatgagtctaagcaaaagcttccctgccacacgtggcaaatgaggaaagcaggcggccaggtttgcaccagtgagagcagtgtgtgcatctgagcactacggtggagccgtggacaagctgcttcacagaggactcaggtcaagaaccccaagaggaccagggagaaagcgatttcttttcctaatttcatcaagtataaaacggtacaaggaaaagttcccagaagttcctatcaggcaagagagaggcctggtcacctgacacaggaagaagagaacaggtgagccccatggggaaggaggtcccaggcactgtcaggctccaacaagatggcctcatggacaccaagagccagcagcacccagctcccaccgaggtgctgcacgggtggggacagcccacctgacagtccctgcacaggtggcagcagtgggacaagagggtgagtactaggagggctcctcccaggacctggcagcaactcagcccaagctgagctggggctggtctggaaagagcccaagacagccggggaacctgggtcccacctctaaccctggggacccagaagtgcagctcccaagcaccaaccatctcagcctgaatgcaagcctgggcacactccaatgctggccccaccggggctcatcacccaggagggagaacggcagggtcctgggtatgaacaaagatgccaagacaaatggaggggctgcagagccaggaactcgggacctccatggctgagactaagaacatacgtgctacagacaccaagactggggaaaaggctgtgcccctcaatcaggctacagcaccaggtcagcaggcatctcgtgagctgccgccaagctgcagggtgggcacagaccacgcccagaggcctcaatgtgccccctccttgctgcacaggtgccaggcttgcgtgcccactctgccctcctcttagcccggcctctttctctcctcacccgatccatcttgaaattccgccccagcacacttttctggttggcatccacaccatcacagctggtcaggaactctgggaggaaggcggcaaagaagccatcaaagtcgactgaggccatgttgtagatggcgatgccaatctcctcctgcagaagatcatgggacttgtggaccaggacctggagcagcacgttcacaaactggaacagcatggcagtccggaagatcttctgcaggcagagagaccaggtgagcagcagccagcccccaggggcctgtcccgggtcccatccactttctgtcacactctccagtgagtaacctgagggtgggacacaggccacaatgcccctgatggaagaatatttccaagagctggggcacttaccttgtggtacagcttctgcttggtgttgagagtctccaagtagaagagattttgtttaaaaaggtggatgtcgggctggagaaaggactgtccgaaagcctaggaaatgagaccaccattttataaactgcaagaccaagcacttctggagcatctaccccatgtcagaagaacaagtgccagggccagggtacccattgtcttgatgcttctggcccaccagctcagacctctacgacgctcctcctaagtctcagagttcatgttttccccaccgggccttgcttcttattatggtctcatatataccttttttaacaaacctctagaaacccatcacaggacctggctttgaagcaagaagctcacacctctagtcaaatccctcagcaatcctggcagacagacaccaaagcctgcctgcctgctcctgctcaagccaagcaatcccctcccttgccctccttcttgcatcccccgtctcaaaagccacaagccctacaggctccttcatggagcctccacctggaggttaagcctctgcctgggggctaagcaaagtatttttaaactgctttggaattcctgggtgtaaaagttactagttcagtccaggcacagaagctcagtcctgtaatcccagcactttgggaagccgaggtgggcggatcactgaagggtgggagttcaagaccagcctggccaacacggtaaaaccccatctctactaaaaatacaaaaattagccaggcgtggtggcggacgcctgtaatcacagctactcgggaggctgaggcaggagaatcacttcaatccaggaggcagagattgcagtaagctgagatcctaccactcactgcactccagcctaggcaacagagcaagacttatctcaaaaaaagaaaaaagaaaaaaattactagttcaggggcaaaaagaaacaccccgcacaccaacacaaagtgccctgctccaacagaaagaatagaaagtgaccatgggggcagtgggggaggccggtggtctgcaggacccccctacaaaacaagtggtgactgctttgtcattctgtccctgggcccctaagctaccagaggaggatcttgtaatccctgcagcagggatgagatctccatgatgaccaatagtttccacttatttactgtttaaagttaggttcatggaagtataacagagtaaacttttgaggtttatctttctatgaattctgacctacctgtggatttgtaccaccaccatcacaaccaagacaggacacttccatcacctggaacgtcccctcacaccctcacccctaaggcaaccactgctcattatctgtccctgtggttctaccttttccagaatgtcatagaatggcatgggatcctaccatgcgtagcctttggcatctagcttctttcacctgacagaatgcatgtgaaactcatctatgctgctgattgtaccaagaatccatgcttgcttattgccgagtgccagtcccttagaggcatgcacgagcctgttcatccattcagctgctggatactcaaagtgtttccagctttggcaattatgaaacagcttctataaacatcagtgtacaggttgtgtgaacatatgctttcatttatcttgggtaaaatacttagaagtgagactgctaggtcatacagtaactacacacttaactttaaaagaaactgccaaactgtgaaactattctccaaagtgcctttcaccagccctcagtggggaccaggcaccagcgtgccaaagaagtcttccaggcaaggacagggttcaagagaaaggcaggggaggcgcaaacacttgagtactgcagacctgaggcctcggtgggtgccagggatgggaaggccagggcaagggcacgtgcctgaaaagaactgccacacaagagtcagtatgtgtgtgtgtgcgcgcgcatgcgcacgtgcatgcctgtgtgcatgctgtgtgctagtagggagctggagggagggtggaaatccctcttgcttccccatgaggaaaagcatgcactgaaaataccaaaagagactcccctagctagactcagatgagaacgtcagacacttgagtgcagaccctgggagcgtgcctgacacagccacagagcaggctggctgtctgggcgaggtgatgccgtcccagtcttccacagcaaggggtatttagcccccagacagtgcactctctccaatggacagctgcatctgccctgaaagcgaatgctccctcccagggcagtgtttctcccagtatggtcagagtcagaatcacagtgcaggtctggggccctcctgcggagactcatattcaggcagctccccgctaagaaggccctcggtgactctggcataggcaggctctttacacttggggaaacagcactatgaggtcagcggaactgacgtttatcaagcatctccaagtgtcatgcactttgtgtatgtcatctcatttaacctcacaacaaacctgtgacccaggcaacattagctccactttgcagatgaagaaactgaggctccaagaaattaattaacttcatcaatactaacaggcagaactgagcttcagacccgagactgtggggcttcgaagacaggactcgctgcagtggtcaggttagaggaagtcacctggcagcaaccccgcccccacgttacctgcatgatggcactgaactggggctcattctccatctgctcctcagcgatccccctctggacactggccagcacggtggacttgaagaagtacctccagttgtgatggagcgtccggaaaaggagctcaaacagctcggccttcacatcaggggagggacgctgcaaagacacacagacgctcagacctgcagcttgcggagctgctccggcctgggcccagggcagcaaagatgcctaggagacgcctcgtgacagcaagccgagtgtcaacactccatccacatgcctgtcactacctgcgcaaaagacatccagcccctggagtcctgtcactgcctgtgcaaaagacatctagcccctggagttggcggttcacaccgcgagttcttcaggagagacatggcccacatttgagagagaatgcacgggtcagtgccaagggcccctttttctgatgagcactcagcttttacactagaaaaaagctaccaagtggatgaacaattaggagtatggatttcctgttctattcgacctgtcagatcttcttgcttgttccttttcccaggataaaaaatgctgtcccactaacctgttggtcttacacaaccacggaggctaaagacagacccaacgccttaaagcgattctgctccccagaaggggagggtttaaagaacacttgggagccaggctctctgggccagtctcctctttcccagtagccaggattctgagaggagttagaggagaagggtcaggctcagcagtgttttctcattgactccaactcccccaatcccttattccaaatgtctctgcagaattcaaaattagaaggcccacatatattcagttcagccttgattaaaattaaatagacaccaggggccacaagcatccacagaagaagcctcataggcccagtgcatttcgtaatgcacagcaaccagacctgtcccagtctcagttcagacagttaaagattaactcttatttatacgactattaccaaaaaaactgaaattaaatctatacttattccgggtcttattatgctgagtgcctgcctattttctaaggaggacaaagggctttcctgtaacactgaaaggtttgtttgaatggtttcaagaacttgccttgtatcctcgagaccatgaatgtttctaataggaaagtacatatgttagaatgtttgctatagaaaaccagagtctcttaaaggtataaaatttgccgcaggagactgatcttagcaactgaccctgtggaataactgccatgcttacactagactagctccaatgaactcaatcaatataaaaacactgtaccacaccactaaaggccttcttccttgggagaaactactttacaagcatattaaactaacaaatgaactttaaaacacaatacattttctgtgaaatctcattcccttcccaatctggagatggggggtgctgcacaggggaccgtctgagcccctacctcggcaatgatgggatacacttgctccatgcacagggcgatgatgctggggaggaagggcttgaacacctggcctggctcctggaccaccacctgcaggatcttcagaaacttctccaccacccggcagcctgtgctgccctcgtggaggatgctctcggctaactgctctctacagaggagaaagccacacagtgagcaaccacatgtttctctgggggccagcatgaaaacccatgctgtggcaagtgcagaacaggagcaaaaagccacactttgtcgccagacccaccacttctcccttgaatctgaaaactatagatggtgggtctgtgcttacctggtaaacatgttgaggaaagtctgtatgatttgctcagtgaaaggcacacccatctgtactctaaggcctcgaaacagagtgaggaagaagctcagcatctcatcagtcacatctgaggaaaggggcagagatatcgtcagaggcttgcacacagtgagaaccagaaccctgggcttcatcaacctactcctgaaatctgcactatcagctttctctacagcttcctgctggaaacatttccccaacaccatcagggccaatgatggaaagtggaaaacgattagggacatgctgagaaaatagttctggtatagggaacctccacctggtggctcactacaggaaatgaaggtcatctcgaaccctccctcattgcccgacatccagtgatggtcagagtttcactggagagggatcactttgtgcccacactgatgaatgccaactgggtcaacacctgagtgcttaagccatttccccctatgactaataatccctgcagctgggtcaggggttaagtggttgaaagtggataatgaaggtgtatttaggttgcatggccctggtccattaaatggattaattgcagaaaatactggttacatatagggcagtttcacttccagatctcaacaatcatcttgtgtagtgtgtttcagccctaactgcacgcaatctgcttgcaagaggcaatgaatatttgctgactgagaagtgcctgatatttctcttgtaaaactgacaagactactataatgctgtcatgagagctaggcaagtacatccacagagctagagaggccctctatcactgacagtgacagacaagggtgaggggaacgatctcggcaaatgcaccttgccacaaaataaggagaactaagccaaaaaagctctcttgccttctcttgtaggtgccaaggcccatatggagagctctgctcacttttccaaagggccttggccctagactccacaaataaacatcactgccctttcccctcagtaccgggtttcgttgcacggaacaagtcaaggcctgtactgcaccgactcagtgtgttctacagatctaagtgggtattctggcccttgttagcaccacccaccagtggggcctctgggccagctcctacctgactgatggataaaagctggaaagagggccagggagacctgaacagattcctgcagcgactggtagcaaatctgtcgagacttggtggactcccccgagatattctccacaatatcttctaagacgctgagtgtctggtggataatcagtttgg

SEQ ID NO: 13830 - DNA, 524 bp, Homo sapiens
ttttcttttttttttttttgttttcaagaagaaagaggcaatgcagcaaagtggtgcagaacacaggagctggagccattcagacccaagtccaactcttgacctcgcccactttctctacagtcctgagcaattacacctgccaagcaccttcccaatggacagactggcaggccctactcccaacaggcatccagactgagcatcaccaaggatgggacaaacagaagcaatgcaagaggaaatgcgaacacgaacatgcaccactacaccacaacctatggaaacaatcaggcaaaacaagactaggagacatatgacaagaaaacaggcctggacgcttcaaaaatgccaatgtcacgaaagacaaaaactgggcatgctcttctggatcaaaggagactaaagagatataacaaccaaacacaataaaactatcctagattacatcctggattttttaaaagcaaaaaagaacaatttggtaacaactggggaaagtgttaatgtggctacattttaaa

SEQ ID NO: 13831 - DNA, 700 bp, Homo sapiens
aacagccctctggggcaagagcatacctgtgatcataacaggaaggaaaaaagctgggaagaaaagaaagaaggcagccaatgaaggagatattcagaatgattgttgtcctcgccactccatggaaattgctcttttcaaagcatcagtgacttctgtcttgccaaatccaaatgtcgtatcttttacgacttttagcaacattcaaaccaggtgattactatgcctttattgcaactttttttattctattatttccttccttcctaccttccttcccttcctcctgagacacacaccttcctgttttttcccctaaccataccaggcattttttccagaaccactttcctggaggttcttctgctcctgattctaaaattcgcagtgccttggctcttctccttctaaacacactctttagcaggtcctgtctatttgtttccaaggctgtaaattcctcctgtccattcatgacttccaagtttataaccccagccctgacttctctgtgctcaagactatgcgtgcacacacgcgcacgcacgtgtgtgtgtgtgtgtgtgtgtgtatgttactgcatagttgagctttctagtgcaatgtcaaacaggcagctcaaactttatatgtgtaaactagaatcattgttttttgaatcaagactgcttcctctccaactgttcctaccccaaccatc

SEQ ID NO: 13832 - DNA, 99 bp, Homo sapiens
ggcaagatctcggctcactgcaacctccacctcccaggttcaagtgattctcctgcctcagcctcccgagtagctaggattacaggcgcctgccaccac

SEQ ID NO: 13833 - DNA, 1414 bp, Homo sapiens
gcaaaatcttacatgtttaaaaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccagataatgtcttcatatttgaacctattcaataaagacatgaagcataaaaa

SEQ ID NO: 13834 - DNA, 2440 bp, Homo sapiens
aggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaaaactaagagaaaaaaaaacccctctattagttacgtaatttaaacatcttacttgttttgtaaaagtgtaattatgcaatttccttttcaaatacacaagactaaaaatacaaatctatcttgttctatttataactgattttttttagttctgtatgtattcgttgaacatatttttttacttccaattgtttttccagatttcacttttcctctttttccataacccgtgaagatagttttaatttgctagttcattttttgctgtatttgaaaatgtaattatttaatatagaaggcacagaattccctgcaaaatcttacatgtttaaaaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcataaaaa

SEQ ID NO: 13835 - DNA, 297 bp, Homo sapiens
tttttgtttttttggtttgttttttaagacggagtctcgctctgtcgctcaggctggagtgcagtggcgcaatctcggctcactgcaagctgtgcctcccaggttcacgccattctcctgcctcagcctcccgagtagctgggactacaggcgcccgccaccacgcctggctaatttttttgtatttttattagagacggggtttcaccatgttagccacgatggtcttgatctcctgacctcatgatccacccaccttggcctcccaaagtgctgggattacaggtgtgagccacc

SEQ ID NO: 13836 - DNA, 9747 bp, Homo sapiens
gcccacgccggccggttggggcgaagggtgtccccggcctgtgccagccttgagtagatcttttcgctagaagattcctgtgccctcaggtgggcgccctttcctctcaccactccctctcctccggagcgggccgaggtgagcgggtgccggccttggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgttttttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacgtagctcaggcctgtaatcctagcacttcgggaggctgaggcgggaggatcgcttcagcccagaagtttgagaccatcctgagtaacatagtgagagccccccgtttacacacacacacacacacacacacacacacacacactttttttaaattgaggaaacggtgagttgaacatgagcaattattccttatatatagtatttccttagtttttcttctcaacattcatttgcccagtgaaaagaaaaagcaagtagctgggaccacaagcgcacaccaccatgcctggttgatttttctattttttgtagagatgggtttctccgtgttgcccaggctggtcttgaactcctgggctcaagcaatctgtccgctttggcctcccaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttgtttggcacatcacttacacatacttgatatgagatagcatgatacttttttgagacggagccgcactctgtcacccaggctggagtgcagtggcccagtctcggctcactgcaacctctccctcctgggttcaagcagttctgcctgccccagtctcccgagtacctgggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattctgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccagctacacagaaggctgaggtgggaggattgcttgagctggggaggtagaggctgcagtgagccgtgattgccccaccgcgttccagcctgggcaacagagtgagactgtctcaagaaaaagagatgaaggaagtgagaaggtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaataaatcacaagaaatggttccttcactgttatactttaacatgatacagctttttaatgttttattttttgagagagagtctcactgtgttgcccaggctggagtgcagtggtgtgatcataaattcttgggctcaagtgatgctcccgcttcagcatcctaagtagctgggactacaggcttgtgccacctcacctggctaattttttttatttttggtagaaatagaatctgtttgcccaggctggtcttgaacactgggcctcaggcagtctttgtgcctcagcctcccaaagtgctggattaatggtgtgagccacagcacctggccaatagctttattgagattataattcaactatcatgatttattcatttaaagtgtacagttcagtattttttagtatattcacagagttgtgcagctgtcaccaccatataaccttagaacatttcatcatcaccaaaagaaaccctatactcattagcagtccctcatatcccctgcttctacctaggtaaccactaatctactttgtggcctatagatttgcttattctggacatttcatatacatgaaatcataaaatacctgatcttttatgattggcttttacttagcataatataaatttttttttttttttaatttgtagagacagggtcctgttatgttgcccaggctgatcttgaattcctgggctcaagtgatcctcctgccttggcctctcagagtgctggcattataggtgtgagccactgcacccagccattagcataatattttagctgggcacagtggcatgctcctgtagtcccagctactagggtgactgaggcaggaggatcacttgagtccaggagtttgaggctgtagtgagctatgatggcatcactgtacttcagcctgagtgacagaggtagaccctgtctctaaatattttaaggttcattaaaataatatattttcaataaaataatatttcaataaaataatattttaaggttcattcatgttatagcatatgtcagtgtatgattcctttttctggctgaataatattcctttgtatggatataccaggtgtttaacattttgaggaactgctgtacagttttccaaagcagctgcaccattttatattcccactagcaaagtatgagggttctaatttctccacatccttgtttttacctacctttttttattatagtcatcctagtgagtgtgaggtggtatctatggtttcagtttgcactttcctaatgactaacggtgttgagcctctttcatgtgtttcttgactgtttccgtatcttttggagaaaagtgggttcagatcctttgcccattttttaattggattattagttgtaagagttcttcatatattctggatataggtcccttatgagatacatgatttgcaaacataaccccgcttctgtggattgtctttttactttcttgacagtatcatgtgcaacagaaagtttttgatgctgtccgatttctctgttttcttttgtcacttgtacttgttatagtatctaagaaaccacaaaggccatgaagatttatttctatgttttcttatcagagttttataattttcttataaatttgggtctgtgatctgttttgagttcatttttgtgtatggtgtaaggtaggggtctgaatccattcttttgcctgttgataacaagtcggtctagcaccatttgttgaaaggactgttctttccctgattatattggtagcctgtagtattggtttttatatactattacaattttgggaaaattcagtacagaattacttggagcatgttgatttgtctgagaaaactgtgaataccagtttcatgattttagggtaactacaaaatgtatattatattctatcctttgtcagatgtgttaatttaatcgttttatataaggtaagaatgctgtacctctgtctaaacacagaaataacatgtattttaatataaagaatgtggaacttctaaactttgaggctaatttttcctgcataaattctcaaattattgtgacatgatatttcataactttactagtagaatccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagatttgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatgagtctctctctcacccaggctggagtgagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcgaactcctgacctcaggtgatccacccgcctcggcttcccaaagtcctgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaattc

SEQ ID NO: 13837 - DNA, 554 bp, Homo sapiens
agtactttgggaggctgaggcaggtggatcacgaggttaggagttcaagactagcctgaccaatatggtgaaaccctgtctctactaaaaaaaatacaaaattatctgggcatggtggcatgtgcctgtagtcctggctactcgggaagctgaggcaggagaatcgcttgaacccaggaggcaaaggttgcgtgagccgagatcacgccctgcactccagtctgggcgacagagcaagacaacgtctccaaaaaaaaaaaaaaggccaggcgcggtgcctcacgcctgtaatcccagcactttgggaggccgaggtgggcggatcacgaggtcaggagatcaagaccatcctggccaatacggtgaaaccccatctctagtaaaaaatacaaaaaattagccaggcgtagtggccggcgcctgtagtcccagctacttgggaggctgaggcaggagaatggcgggaacccaggaggcggagcttgcagtcagccgagatcgagccactgcactccagccggggcgacaaagtgagactacgtctcaaaaaaaaa

SEQ ID NO: 13838 - DNA, 94 bp, Homo sapiens
ctccgtctcctccgcgctccgccacagccggccgacaccacaccagccggggagccgccgccgccgccgccacctctgagcagccggctgggag

SEQ ID NO: 13839 - DNA, 5365 bp, Homo sapiens
attagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccattctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttcccgcataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtg

SEQ ID NO: 13840 - DNA, 586 bp, Homo sapiens
gcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaagttcagagtagatcatttatattcactgagtatttactgagcaattactgggcgccaggcgctattctatgttcttgaagttttcattccagcaggaagagaaatctagagtatgtcagatggtgataaatatggattagttcagcaattttaaaaaaggatttttatgtactgcacactgttacgaatatacaaaatcagtcaagaatcctgttatagtttttgtaatgtacaaaaagtgaaggtgtgtgcacccaccccatttttatagagggtgatcagggaaagcctcagggataaggaagcatttgagcagaaacctacagaaagttagagaaggacatttatccgtgagaaaaaatgttgtaagaagagaaaatgctatatacaaaggattctcctgccaggttcaaggaacactgagtagatc

SEQ ID NO: 13841 - DNA, 1164 bp, Homo sapiens
gttttcaactcaatgtctccgagataagagcaggacccggacggtaggaatccacaggctgtgtccctaccatgtaaccagcgaccctgtctccacaagtctgccttttactatgccttgtatgcactgcctcctctctagttgcattctctctgcctgcttcagcccttgcatatctattccctgggctcctccagtggttcctgtgtagtctgtgcctccaacccagtggtttctaaccagagaactattttgctccccaggggaaattcagcagtatctggagacatttttggttgtcaagaccagtggggtccttctggcatctactggatagaagccatggaagctactaaacatcctacaatgcacaggaatcccacaaaaagaactgtctagctcaagaggtcagtggctctgaggttgaaaaactctgctccagccatatctgcctctaatccattctctacacatcaccagagtgatacaaaatacaactcccatgccattgatatcattcccatacctgaaatccctcaatgcctcctagctgctctcaggttaaagtctaaattctcctgcaaatcacacgaggcccataatctggccctctcctacctttctacctcaccttcaccatcccccagaaccctcttccctgaaaccacactcacacctcatgcaggtgaaacagaccactccgttaccaactcttcctgtccatctctcccatttattccttagcccactgattttatgtcagacactccaatgggactaaaaaggaacaaatgccctcaaggcagctcaaggcactgatatccagtagggcacacagaaaagtgggcacacaattcaatcagcagaggcagaactttgtcatcgcctctgtgatcccactgccatctccccagtggactgtgagcctccagaagagagagcatcttcatgtcttcatctttatagtccacaggaacttggacatggtaagtgtggtctacagggtgtacaacttgtatttgtcacaattgttgcattaaggaatgaatgaattcccagcctctttaagtttggctctagcacagaaataaaaagaaatgaaacattaaaatatagagatgaaacaaaattcttcatagtgcatgcactcaaaagcccagaaac

SEQ ID NO: 13842 - DNA, 406 bp, Homo sapiens
tattcaaaggttccaataagtttattttgtgtgctttgttttcaatttaattaatttcatcaacttaatttaaacaaatctttgaaattaataaaatgtgagatgtctgcaggtgtttgcagcaagcattgtggtgagattcttccctgaagtaaggagagtccttaaaaacaaagatgcctagaaacacacatattattattatctttaaaaatataacaaatgtgggggttgcagtggacacttcacttttttttagcttgtatcaaaactgttggacaatgtaaatgaaggatcaagaacaagaagcctgggggaataaatgggatgacgagtgtagagatacttgtggagaactctttattgccaccaatttaattgtgattacagtggcagacatcaacat

SEQ ID NO: 13843 - DNA, 141 bp, Homo sapiens
ttttttttttttttgagacagagtttcgctcttgttgcccaggctggagtgcaatggcatgatctcagctcactgcaacctccacctcccaggttcaagcaattttcctgcttcagcctcccaagtagctgagattacagg

SEQ ID NO: 13844 - DNA, 1720 bp, Homo sapiens
gactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaa

SEQ ID NO: 13845 - DNA, 1438 bp, Homo sapiens
ctcaaactatgcattaattttgcgtgcatagttctaataattttaattgtctcatccagtcgaggggttgacagactagaacagaccaggctcagttcacatgctgcctatttttgtaacacttttttttgtttgttttgttttgttttgtttattttgccctacaaaaactgatttgagtagttgtgacacaactatgtgagactgtattgagactacatggcctgccaagcctaaaaaatatttacacctgaccctttacctgaaatgtttgctgacctctgaatccgagagttgaagggaatctataaaagtggctcatattaccaaactcgtagagcttgtgaagaataatgcaaatctattcatttatatattcttttccagtgtttttagaaggctcactgagcacagtacctcatattccagatccaaggattcctgaggaatccaaattagtatccagaaggttcattggtagtcatggttataaaccagagcaaaagttaatgggaagaaatggtaaagagtcactgcattgcagctgacacctgggattttaaaatctttttttcgtttttgagatggagtcttgctctgtcgcttaggctggagttcagtggcgtgatcttggctcactgcaacctctgcctcccaggtgcaagtgtttctcctgcctcagccttccgagtatctgggattacaggcacgcgccaccacgattggctaattttttatttttatttttatttttatttttgagacggagtcttgctgtctcgccaggctggagtgcagtgacatgatttcggcccactccaacccccgcctcccaggttcaagtgattctcctgcctcagcctcccaaatagctgggactacaggcgtgcgccaccacgcctgggtaatttttgtatttttagtagagatgtggtttcaccatgttggccaggatggtctcgatctcttgacctcaggtgatccgcccgctcggcctcccaaagtggtgggattacatgtatgagccaccacgcccggcccacgctcggcaaagtttttgtatttttggtagagatggggtttcaccatgttggtcaggctggtctcgaactcctgacctcgtgacccgcccaccttggcttcccagagtgttgggattacaggtgtgagccaccgtacccggccaaaatccctttagttctagtcagtagaggaataaagcactgttctttcaaatgtgaacccctcttgatcagtattgtccaatctggcctgttctttaaccagtcagcctcttttcctgcctcttgcatgggctttttgttgttgtttctttgtttgttcatctatcatctcttgctttaatcataacctaactttccctgatgtggcacgtgtaaaactgaaaaacagaaactctatctggtaaaaaaaaaaa

SEQ ID NO: 13846 - DNA, 300 bp, Homo sapiens
gttgaaggtatgtgtcagttttaaccaggtgttgagttatttgatcactcctccaaagattatttaatagtttcaataatatctaatgatgtgtgggaaaccgtagaatttttcatacaaactgggacaaatgaacatgcatactattaaaatacttcctacaataggcataaaatgggctttcttaggtgaaccaggaggtatagttagcctaatcatatgctatgattattagtaatggttttctgtgttttatcattcatatttgtaaatcttttttgaatgactacttggaaatga

SEQ ID NO: 13847 - DNA, 1577 bp, Homo sapiens
ccttaacaggagtatttgagaattaccttataaatgcagagaatgaacatgaaaagcatcagactttatctagacttaagatattattagaaaattcactgaacactagataaagttaagtcctaaattgtttcttaatttattcatgaattctttgagtttctgagatagaaatttggagatcttggtaatgggcagtggtatactttgggaagtaggaaggccagttgatttgtgctttgatggttgttggaggtcattccatgattggaatgtgttgattttcttgatttatttgttattacaacaaagcagttattcttggacagttgacatttcagaactaaacaatccttaaatatacttggaattacagaaatggaattacttggcacgtttgtttaataatcaacagggcagtcctgtttaattattttcacacatttgagtcacctgtaatctctcccctaatctcttctatgatcttaaatttgcatcatgcttgacatcatgaggaacattgttgctcagaaacatatcctttgtcctttaataggcagtgctagctaatcagtctggttgctgaatgaatgatccatcttctgtagggccatgttttaagcctgtgttagtcagctcaagatgccgtaacaaaatgtagactgggtggtttgaacaacagaaatctatttcctcacagtccttgaggcagaaagcccaagatggagtgtcagcacagttgggttctggtgaggcccctcttcttggcttccagacagccaccttctcaatgtgtgctcacatggccttttgttagcatctatgttagcagagagaccaagagcaagctctctggtgtcttttactataagggtactaatgtcatcagactaagctctgcccttatcacctaatctcctcccaaacaccccctctccaaatatcattacactggggggttaggccttcagcatatgaatttgagtgggaacacattcagtccataacaaagcctaaacagtactgagcctttaataatcagatatgatctctcttaagtttcatactagttaatgaattccagttagactaacttttgttccattagtagtagtgctttaaacctctatgtgaagtaaactattaaccaattccaagtcctaaatttcccatacccattatgaatgcgctataagttataaacattctccaggttaccagttttaaatagcaattgtgaaagactaatgcaagtataaaaacactttgtgaggctgggtgtggtggctcatgcctgtaatcccagcactttgggagaccaaggcaggcagatcacgaagtcaagagatcgagaccatcctggccaacacggtgaaaccccgtctctactaaaaaaatacaaaaattagctaggcatggtggtgcgcgcctgtagtcccagctactcgggaggctgaggcaggagaatcgcttgaacccaggaggtggaggttgcagtgagccgagattgtgccactggactctagcctggtgacagagcgagattccatctcaaaaaaaaaaaaaaaaaaaaaaac

SEQ ID NO: 13848 - DNA, 356 bp, Homo sapiens
cccttcttatggaatatggtagaatattatttttaaggacttttaaaaaaattattaaaaaacttttatgttccttcgtctctctggcttataaaaagaaataggatgtgtttgcattgaaatctggcaatgattaattaactttctaagtgaagtttaaagaatacagaaaaaataacccatgcatattcagtagtaacgtgtgatagatttctaaaaaccagtgatcacagtttctttccccctctttccattctagtgaaaaagtttttacttcctgctgcatagagctaatataaaaacaccttttcctgaaatattttaaatttccttttacttatttgagaaatctttaa

SEQ ID NO: 13849 - DNA, 1479 bp, Homo sapiens
gctttgtcacacaatgtaatcttgtaatcctctgtccatctgtggccggcctgcttctctaaacgggaagactactgcttcatgctgctctattgcttgttgcctaccatctctgcctcatggtctgtcagtcattattgctcctagaccagctaagttgccccagtgtctcatttctgggtcttctgtgtgggctgttggtctgtaagcatctgtcagtatctaagcctgctgtgaggtcatccctcacaattacagaatacacttggtatacaaaaacacatgtagaggaaaagaaaattactgaagttccaaaaaacacctacaattggaccaagaattggcttatttttttttttaaagaaagagcagcttctgtatattatttacaaaggtcatcatttcattgtctgcactggacagactaataattttttacccataaaattgtttagggttagtaccctgttaggacctttttgaacgtaaagaaggttttactttccatttaagacaccaggtttgaggtcaaaagataaacataagcccagagaagcaagcaattctatttcttctcatccctgttgctgagattgctgtaggtgaaatattaagtatccctggacagggcagaagtatgtaggataggaggcttgtgtgtagtgaggcttttatgaataaatcagtgaaatctgacacagaagccagggctcttcccctgatcaaatcaacaagatggccttaagtgctccgtcaactgtggacactgtggggagaggctgatcagttggatttggagccagagataagagtcaggagggccttgttcctctttacaaaggaattgacatgactaaattgaggaagtctcaccctaaggtgagatgccaaggaagatggcttgctgtcttactgtgtacccacatccaccatttcttataacttcaacccactatctagcatttgactgttctctcaaaggaactgaggcttttttatttctattataattgatagtcctattttacctagtcataaaataagtcctcaaaatatactgttatgaaaagtaaacaaaataaaagttgtgtttgacattttagatcctatttccaaaaaaagtaccattttattgtagtatgtggttatttaaaaccttaatttattgtcatttttagccaatacactattttatcaaaaagaggcagattgcagtagaagaatgaggaaaatgaaataccattcaggatttaggctgtgtcctatgctgcttctcctacacctctggacctctggtacacacacacactctctctctctctctgctataaaatgaggctcgcttttcaaaatgattatactgaaatttcagatgtcaatgaaatataattatgagtgtttgtgtatacttatgtatgtgtgtttccagagtagtggagtgatatactttataaaagcattttcccaaaattacagaaa

SEQ ID NO: 13850 - DNA, 1479 bp, Homo sapiens; identical to SEQ ID NO: 13849

SEQ ID NO: 13851 - DNA, 1479 bp, Homo sapiens; identical to SEQ ID NO: 13849

SEQ ID NO: 13852 - DNA, 1679 bp, Homo sapiens
  misc_feature (81)..(81): n equals a,t,g, or c
  misc_feature (229)..(229): n equals a,t,g, or c
gcagtggctactcagggtaggctggtcctgagacccatccccgacacctctcctgctgaaccctcaggctgctccccacanccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtnccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggccctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacatgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggcctgtggacgggagaaatagcaaccaatccaacagcggg

SEQ ID NO: 13853 - DNA, 632 bp, Homo sapiens
cacggtcgtggatgaggcttttaatccggggtcagccaggtacagcattggggacatccccaggcccagggctggcgatgtgctgggaaggaacttaggtagagaggtgggaagtgaaagcatagggaggccatagccctccagaggggaattctaagacagacagttgaaggtgaggcctttgaaaaacaatgggaacatcacctcccaaagagggactgaggtggctggaggaaccagagccgcctctgcactctgcaccgagggtcgcgtgtggctgtcaggagagcagcgtaagcctgtggagcctctgctcgcttcctgctcagaaagccagaagagagctggggcaggccaccagggcaccagacactcaccaagcggccatcaggactgggatgagaggacagaggaaggacactctgtccccaaaccctcccgtgtcctgacggccctagaacttggaggtgtcaggacacaacacagactcaaggctcctggattgaaaatgtggagggcttgggccaggcgcggtggctcacacttgtagttccagcgttttgggaggcccacgtgggaagatcacttgagcccaggagttcaagaccagcctgagcaatatagtgagaccc

SEQ ID NO: 13854 - DNA, 1415 bp, Homo sapiens
agtggggcggaggggacgagagtagtatctttggttctttggccctgacgctgtgttcctcttctcccagggcatcagcagcctgttcagctctctaaaagttgtccggctgctccgtcttgggcgagtggccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggacatcgccccatccacagacattgagaagatctttgcagtggccatcatgatgattggctgtaagtatgacagtgctggggtggggttggccatctcttctgttagctggaaacagggaaatggctacagtgccagcaggatcaggagaataataacttaaaacaaggaagagtttttttaagactaggcttacagttaccctgataattaaagcagtatatgcttactgcaaaaaaatttagaaaatacaaaagagtgcaaagtagaaagtaaagactatccataattctgcttttcagagataactactaatactgttggtgtcttctcttacagactattttctttgcatatctgaatacatatagatttttataaacttaaaatgagatcttgctgcatacgcactttagtaaactactcatagaacagtgaattatggaagtcttttcatgtcaatttttttctttttaataaaaattgtatatatttaaagtatgaaatgagattttgatatagtgaaatgattatgacagcaaagcaaattaacatatccattcctttacatcattaccttttttttggtgaaagcacttgaaatctgctctctcagcaaatttcctgtaggcattacagtattattaactatagccgtcatgctacatgtcctacatgtcaatttgaacatagctgtagcttggcatatagtctaatgtagtatgagaaaaagaatgtatgaaaaatgaatgcaaaacatctcattaattgtattttatattgattatatattgaaatggtaatatttctgatgtatcggttaagtaaaatattctcttagaattaatttaatctgtttcattttccttttaaaagtagctcctaggaaaaatttaaatttaatcatttggacggtgctggtctagataaacatttttgatgtcttgcttgatgggaaattttccaactcaaaaacaaa

SEQ ID NO: 13855 - DNA, 255 bp, Homo sapiens
  misc_feature (34)..(34): n equals a,t,g, or c
ctctgttgcccaggctggagtgcagtggcacgantctcagctcaccatgcaagctctgcctcccaggttcacgccattctcctgcttcagcctcccaagtagctgggaccacaggcgcctgccaccacgcctggctaagttttttgtatttttagtggagacagggtttcaccatgttagccaggatggtctcgatctccttacctcgtgatctgcccgcctcggcctcccaaagtgctgggattacaggcatga

SEQ ID NO: 13856 - DNA, 18367 bp, Homo sapiens
cttatttgcaggtggactggcagaggaagtggacgacaaagttcttcatgctgcgttcattccttttggagacatcacagatattcagattcctctggattatgaaacaggtgagttagtgtctctcacgttcagaatcctcttactaggaaaataccttaaaaaattaaagtcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttgagataagacagatttttcaatagaccagtagggagataggtttgaactacattgagatttgaatgttgttttaatctacctgatgggtaccccatcccacctgcaccttcttgcagctgtgctattaaatgaggcagcgggaaagcctagccccataatgggggtgggtgagggcgggggttcttggcctctgcacccctgggtgggtttcccatcgattggtatcacaaccacagttcagttttctgtttacctttgttgtcatttttaagattatagttttaggcctagttttatcatcaaccttgcatatgattgttagcaaagtctttaaactctctgggcctgggaaatctttatttgcaaaatgataaggttatgttggctttctaagggccttctagtctctgagttctatgataaacattattgtgcttggtctttctagttagttcagcattttcctgaagataaagactgagcatctttatcaggttttaggattcatgctttatgcacagttgatgcgcaaaatatatatttagatagataattgataggtcaaatgactttatttttctaattgctttgcatgcaatggttaaggttttaagtttggctttcgtagaataattgaatacttatcaattaaaaatacagtttactattcagctatgtccattaaaaaaacaaagtttattattgcttaaaatattgtataagaagaatcaagaatgagattccttcttcctaaatagtgattggatagaacttctggtgtttggatacgacatgtaactgacttcactttgtgaccatcctgtttcttcccactaccccacatagtaattacttgtttttgtttttccattttgtagaaaagcaccgaggatttgcttttgttgaatttgagttggcagaggtgagagtctgtgttactagtgtctagtccttggtttgtgatgttgttactgattacaaaggaagcttttcaccatttggttaggtttttgggccttaggctgatgcttccagagagatcagaagtaagtgctgttctaaggaaagcgtctctcacataatcagactggactgtgaataacatgtcagacctgccaggccctcccattcttgccctgcagaggagctagctcatgcacccctgttcattgagcattcttgcctggaagtagtgattatttcttgtgccttcaactagatggcaaattgttgcaccaccagctctaaaatcagccaggaagtgctctttgttagaaacacacaaaacctaggcaagaaatacagaggtggcatttttctggatttttgctactgagcatgtgtttagacaccataagaagcatttggctgcaagcctaaacttgtacctttgtctttccttggcaggatgctgcagcagctatcgacaacatggtatggctgggaatcttaattctaactaaagttgctttttggtggtacagaggctccttattcatatatcagtgttctggacttccaaagttacaaggttgcatggggaggtaaaaattctcacatgaaaatattcactgtgaattgatcacttataaaattagttcttactcagactccttcgccatttcagaataatgtaagtcctcatcatccttgttgaccagtctctcactggctctcccatgtttaggataatttgcagacacagtgcaaattgattgcacggtgtaactgcatattttgcaaaatagcaggatttcatgaagtgttagaccaatttacaattgagaagagaaatttaattatggcaggtgcaaatcactgatacaaatgatttggatattctggaaaggtccttgggaaaaatgatgatgctctttagtatttgtgccttccttgagatccttttagttttcatgtctgataagaagtgcaaagataccatactgttgatagaattttgttggaaaaataatacttcagtgcctgttacttttctttctttctttttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtaatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggtctttgtgtgctgctatgaaagaaaggggtgtgagttccctgaaacccacaggtggctttggggtggctgcatagcttactggtagaggcccagggattaagggaggacaaatcatgagtgtgtctcagaagtatatggaaagctggctggccctcttttaacctaagagagtttaagcagctggattttcaatcttttcagaatgaatctgagctttttggacgtacaattcgtgtcaatttggccaaaccaatgagaattaaggaaggctcttccaggccaggtgagtaggagcaacttccagattccctgtgatgttctgcagtttggccttagttgcattttttgtctctatttacttggaagtagatgctaaatgctgcttcctggtagataggagtagatgatggttcacattgggaagggcatgcaccacctttttagagaaacaagtgagtttgagcttctcagcaaagccaaagtgattgtttctgttatgagagaaattcctgcctgagctcatctttcccagttttcttgatattccattcctggggtctccatcaagggctgaaatcagcaaaggctacacctttgctttcggcatagctattttccttagccctactgagagctggacttcagggcctacattctggatgggaactttccttacccctgggagttctcagtggggaattgtctggcatacaggccacatagcatcttccactttgctgaccaaagcagctacttttcagttcaagctgacagcttgaatgaacatttgtttgattctttcctttcagtttggtcagatgatgactggttgaagaagttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatgaataatgaattcttagtactttggtaaagtcaatattgagttcttagtactttggtaaagtcaatatcgagtgaattcaagggcgaaactttgggtctcttgtccatgttgtgttctatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgggaacctgctggggcacttccccctgattctcagcatagtctctgacagttgcttcctgggcgtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtggagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggaggaagcagatgcatctgagggcaagcatgatgagataacacccccgtgtgtgaggctcaggttagccagtgctgagacctcctgtcgctgggcatccagctgggtgctacggccatggctcctgcctcctgcagccctatcagggcccaaggccttccccgtcagcacttgctccagcctacgcactggagttgtgttctgggtgggtgtgtagaatactcgcactcctacttagggcgtcagggagctctctctaactagcaatttcttctgcacctagggagagcccattgctaaaaaggcccgctcaaatcctcaggtgtacatggacatcaagattgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtacctcagccctcactatgcgtaggatgtcctagtccagagaccctctgctttaacctaccaaagactagacccccagctggctaccaggttggggaggggtggcccccagctgcagagtcagggaaaggatcccaaagattaaccactttcttaaatgggctttcagccaaacttactgtctccaggattacctgcaccctttcctctgagcttttggagtgcaaattgagttgcttcttggcttttaccagcttaagattcagctttctcgggtctgctatatcatttaggactcatctattttgttttctaacttcagaaattttgttgctgttgtctcttcctccctgctttttaagtttattttttggctattttagccactttaaagtgtttgttagcagtaattactctgttcgaaatttttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctcccgagtagctgggattacaggcgtctgccaccatgcccagccaattttttgtatttttagtagagacgaggtttcaccatgttggttggccaggctggtctcaaactcctgacctcatgattcgcctgcctcggcctcccatagtgctgggattacaggcgtgagccaccatgcctggcccacatcttctcttaacaggtgtgacatggcatctcattgtggtttttatttttattccctactgactaatgatgttgaacatcttttcatgtgcttgttgaccatttgtatatcttctttggagaaacatcttttcaaatctttggcttatttattaactggattgtttgttttgttttttttaagagacagggtcttgctctgactcccaggctggagtgcagtggtgagaacatggcttactgtagctttgaacccttgacctccagtgatcctcctgccttgacctcccaaagcactgggattacaccgtgcctggccattttgttgttgaattataggagttcattatatattctggatattaaacccatgttaaatatgatttgcaaataagcattctcctgttctgtgggttgctttgccctctattggtacggttctttgatgcacgtcttaaattttgataaaatctaattatttttttctttcacctctgcttttggtgtgacatttaagaaaccatcaccaaatccagagtcatgaagatttgcccctatgttttcttctaagatcctttggtttttcttttaaaaaatcagtttcctaccaatttagtgtggttttaaaagggaacagagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggttttttattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagcatgaaagcatgcagttatcaacctttaaaaaaaatcttcatccggttgccgggtgcagtggcttagtcctgtaatcccagcattttgggaggcagaggcaggcggatcacctgaggtcaggagttggaggccagcctaactaacatggagaaaccccatctctactaaaaatataaaattagccgggcgtggtggcgcgtgcctgtaatcctagctgctcggaaggctgaggcaggagaatcacttgaacctgggaggcggaggttgtgatgagccaagatcgcaccattgcactccagcctgggcaacaagagcgaaactccgtctcggaaaaaaaaaaacaaacttcatccttgtactcttgttccctctccagctatcacccatgcccctggtcccccatcttttttcaagaagtaaaagcataacttcttgaaaacatggtacagacttgctgccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcattatacttaccagttgagcatcccaaatctgaatatctcaaatctgaaatgctcgagtgagcagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctataccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccagagtgctgggattacaagcattagccactgcgcccagcctctagcaggatgtttgtaagggccaagaggatatgagacaattcattgtgccagacattgcagaacatctagcattccaggcccccacctgctaaatgccagtagcacccccacaatatttcagacagtcaaaaacactttcaggccaggcacggcggctcatgcctgtaatcccaacactttgggagtctgaagtggcagcccaaagccagaggatcacgtgagttcaggagttcgagaccagcctgggcaacatagtgagaccctatatctactgaaaaaagaataaaaaaattatccaggtgtggtggtgcacgcctgtagtctcagccgcttgggagttgaggtgagaggattgcttgtgccccagagattgaggctacagtgagctgtgatgcactcctgtactcagcctgggtgacagagtgatccccatctcaaaaaaagtaaattcagatttccaaaggtttcctagggacaggacaccaaccccactgagaagcagtgccctaagcagtcacacccggtcccagggctttcagcggtatctctgagttaagtttgtgcagactggcatctgcatgctgatggctccctgagctccagactcctgtccaactgcctgcctgttgtcttcactggatatcccacgagcatctcacactttacatgtctaaaacagctcttggccttctcccctaaactcttcctcctcctcttccctgtttcaataaatgactccaccatccacttagccgcttgatcagaaacttaggagtcattgtggacacacacacacatacatacatgtacacatacacacacagacacacacatatacatgtacattctcttacgtgacaaatgtccatgttaccaggcctcactgtgtcatagctgtcattttgaatggctcttttccactgattgtgagctccaccagagcttggactatgttctgctcatcagtgttcccagggcttaacagggacctggttgtcaagtagacacttaattgttaaataaatgaattaatgaaagaacagaccagtataaagtgattgaaacacctcacttaccatttcactgactattaactgaatccaagataaggtggccgcatttgcatgtgatctgtgcatccccgagtctgagcctgactggctgaagggctgtcaacagcctgcacagacgtcctttaagggctggtagccagggttcggggagctgatggttgttctctccctcaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctcacttctattctgccacaaaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgcctaatccagcccactgcctgtttttatgaatcaggttttattggaacacagccacgtccatttatttacatattgtccatggtggtttcttactgcagtggcagaggtgcgtaaggggctatagacacaatacaggctatggtccctgtattagggttttctagagaagcagaaccaatagggtgtgtatatatgtagaaagagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgttcacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcacctggctgcctcgggaaaactctgacctctctgggaagtggagccagtggctctgtgggcgtcctttcctgcagcctggagagcaaagcggctttccctgggactgtgtggctcctgtcccaactggcctccccattccacattcccattgctggaccagcaccaggactgggcacagggcttccttttgctgattcatttcccccctaactcattcagagttgagccccatctgagtccccacatgctggccctgaaacggttacaaaggctgaaaccagggatggcaggcccaggatcagtgctgtggctgttggagtgtcctctccaacagcatgacagccgcctccaggtgctcccagcatctgttgcagtcatggcagcctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaatagtgtgtttatttgacttgtgggactgtagtgatttgaattgtattttattttttatatatcccactttcctccaaaactgcattatttttttgagaagtgaaagacatttttgaaaaagggggtcaagtgcccatccagggttcctttcaaaaagggggccaagcagttgacctggatgggcagttcccccatgcaaattgccacccaagacacctggtgggtacagacctctctcagcaggacatgggatcccattgtctgggaacacagcaaagtttcacagccgctgccacaagtgacacttgctaggcctttaaaggctataagaatacaagtcccgccctctgagggatgccatgtgtagatggtttaggaaagagcacagctctgaaataaatacatcatcacctgcagaacacattttggtttaatggacagacatagaagtggctcaaaaataagcaaattcatttgtaataataccagcaaatacctattgttaagcatttatatgtcagacatcccaaagatttgtgtacatatttagtctttataatagctttgggaggaaagaaccaatatcatactctacaaaggaagaagcagaaccaggattcaaatctatttggcaccaaaaatctgcctcttgctacactgcctctattcctgtttctttggaccttttccagaacatgttacttccctgcctcagttagaagttagtgactacgaatcccctgctgacttggcctcaaggccagtattgcaccgcaaggaccaagactgctgggcattcctcttttgcctgttgtatgcgtcctctcttcctgtcaactgtcattgatttctcattgctgtcagtagatctgaaacaaccaccaccatcatccttccaaccctcatctggtgcaacgagataaacaggccatgccctgagcaaagaaaagggaaatggtggtatctgtgctgccagcctgggccacccactgcagatgcacatgcttggctcagcaaacggataaggattaaattcatggactttgtgttcattcacaattgtttcattgctcaagggatttttctattttatttcatttggtgactatctggatgataaaagttgctgaaagtctgatggccaactaggtagacaaagccttatgtttttccattgttctgtatgaaccaggaggatcacggctcgtattggttcctgctatgcacagcttgattaatgggtaaggtgtactccatatctacaaaccttcaggtagtttacagacattcttggtgcacccctaactatgccagatcattggctgggcactaaagatacaggtggagtaaaaaattaattgtcaaaataactggctaatttaaaatttacaattgcctagaagaccatctttgatgttaagaaggaacaattaagtaaatactaggatggcaaacaggttccataatttcattttgttgagacaacagttttgctcatgtcaccaggctgaagtgcaatgttgtgatctctgctcactgcaacctccacctcccaggttcaagcaattctgcctcagcctcctgagtagctgggattataggcatgcaccaccatgcccaggtaatcttgtatttttagtacagatggggtttcactgtgttggccaggatggtcttgaactcctgacttcaggtgatctgcctgccttggcctcccaaagtgctggggttataggtgtgagccaccatgc

SEQ ID NO: 13857 - DNA, 19633 bp, Homo sapiens
gcgcgcgagcaagatggccaccaccaagcgcgtcttgtacgtgggtgagcaggaggggttgctaggcggagtctgagtgaacgcgacccccaagggtcggggcgtggggtgggacgcatctctgaaccaggaggacggcgagctgctgtcaaggccgggtctctggcggtagtgctggcgatagctctggctgtgcttaaactccttccaaggtttcccactgtcctcaggaaaaagtgcagacttcttagcagtacgcacttctccagcttctttgctttgcttcccgattcgctgggtctcccgaaaaatgacccacttgcccccaaggttcaggttatttcacacctttgggcctctgcttttgcgactcccttgcagtgaacagccttgccacacacctcaggtgcgtgaacccgagacggaatgattattctgacttcctagcccgctgagctccagcgggccccgaggagcggtaaaggagtattatggcccttcggatcctctcgttcatttgttttacaaacattcagtgcagcgacggctcagccccagcccctgccataaaggaaggagttcccagactagccagaaaaaaagtggaattacctcagtagcacacttttgataagcgctgtagtgaggatggatcatgataatatgggcctggctgcgggacaaatgacccatccatctggagaagcgagggcaaattctggatgcggcgatgccagagctgatgagcaggagttagctacgtaaccgaagcagaggcaaggccgttcactgcaagggagtcgcaaaggtgtgaaatagcctgacacttgggggcaagtgggtcattattcgggagacccaggaaattaggaagcaaagcaaaaaagctggagaggtgggtactgctaaggagtttgcactttatcctgaggacagtgggaagcctttgaaggagtgtaagcgaaaagttacgggttcaaatttgcattttcctaagatcattctagttggctttgtggagttgatggaatggaggcagggaggtcagttgtgaagctattgcagtaatcccaggactagatgagagtctgaaagaagggcgaagagaggaatatttttcataagtatgggtgggcagagatgagagggggatgtttgtttacccaaagaactgaatggaagggtcctgtcccctggctagcatgctaactgggctgcaaggacttctgcaagagtatggagatcagtggctcagaaggcccttggcttatttgcaggtggactggcagaggaagtggacgacaaagttcttcatgctgcgttcattccttttggagacatcacagatattcagattcctctggattatgaaacaggtgagttagtgtctctcacgttcagaatcctcttactaggaaaataccttaaaaaattaaagtcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttgagataagacagatttttcaatagaccagtagggagataggtttgaactacattgagatttgaatgttgttttaatctacctgatgggtaccccatcccacctgcaccttcttgcagctgtgctattaaatgaggcagcgggaaagcctagccccataatgggggtgggtgagggcgggggttcttggcctctgcacccctgggtgggtttcccatcgattggtatcacaaccacagttcagttttctgtttacctttgttgtcatttttaagattatagttttaggcctagttttatcatcaaccttgcatatgattgttagcaaagtctttaaactctctgggcctgggaaatctttatttgcaaaatgataaggttatgttggctttctaagggccttctagtctctgagttctatgataaacattattgtgcttggtctttctagttagttcagcattttcctgaagataaagactgagcatctttatcaggttttaggattcatgctttatgcacagttgatgcgcaaaatatatatttagatagataattgataggtcaaatgactttatttttctaattgctttgcatgcaatggttaaggttttaagtttggctttcgtagaataattgaatacttatcaattaaaaatacagtttactattcagctatgtccattaaaaaaacaaagtttattattgcttaaaatattgtataagaagaatcaagaatgagattccttcttcctaaatagtgattggatagaacttctggtgtttggatacgacatgtaactgacttcactttgtgaccatcctgtttcttcccactaccccacatagtaattacttgtttttgtttttccattttgtagaaaagcaccgaggatttgcttttgttgaatttgagttggcagaggtgagagtctgtgttactagtgtctagtccttggtttgtgatgttgttactgattacaaaggaagcttttcaccatttggttaggtttttgggccttaggctgatgcttccagagagatcagaagtaagtgctgttctaaggaaagcgtctctcacataatcagactggactgtgaataacatgtcagacctgccaggccctcccattcttgccctgcagaggagctagctcatgcacccctgttcattgagcattcttgcctggaagtagtgattatttcttgtgccttcaactagatggcaaattgttgcaccaccagctctaaaatcagccaggaagtgctctttgttagaaacacacaaaacctaggcaagaaatacagaggtggcatttttctggatttttgctactgagcatgtgtttagacaccataagaagcatttggctgcaagcctaaacttgtacctttgtctttccttggcaggatgctgcagcagctatcgacaacatggtatggctgggaatcttaattctaactaaagttgctttttggtggtacagaggctccttattcatatatcagtgttctggacttccaaagttacaaggttgcatggggaggtaaaaattctcacatgaaaatattcactgtgaattgatcacttataaaattagttcttactcagactccttcgccatttcagaataatgtaagtcctcatcatccttgttgaccagtctctcactggctctcccatgtttaggataatttgcagacacagtgcaaattgattgcacggtgtaactgcatattttgcaaaatagcaggatttcatgaagtgttagaccaatttacaattgagaagagaaatttaattatggcaggtgcaaatcactgatacaaatgatttggatattctggaaaggtccttgggaaaaatgatgatgctctttagtatttgtgccttccttgagatccttttagttttcatgtctgataagaagtgcaaagataccatactgttgatagaattttgttggaaaaataatacttcagtgcctgttacttttctttccttctttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtaatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggtctttgtgtgctgctatgaaagaaaggggtgtgagttccctgaaacccacaggtggctttggggtggctgcatagcttactggtagaggcccagggattaagggaggacaaatcatgagtgtgtctcagaagtatatggaaagctggctggccctcttttaacctaagagagtttaagcagctggattttcaatcttttcagaatgaatctgagctttttggacgtacaattcgtgtcaatttggccaaaccaatgagaattaaggaaggctcttccaggccaggtgagtaggagcaacttccagattccctgtgatgttctgcagtttggccttagttgcattttttgtctctatttacttggaagtagatgctaaatgctgcttcctggtagataggagtagatgatggttcacattgggaagggcatgcaccacctttttagagaaacaagtgagtttgagcttctcagcaaagccaaagtgattgtttctgttatgagagaaattcctgcctgagctcatctttcccagttttcttgatattccattcctggggtctccatcaagggctgaaatcagcaaaggctacacctttgctttcggcatagctattttccttagccctactgagagctggacttcagggcctacattctggatgggaactttccttacccctgggagttctcagtggggaattgtctggcatacaggccacatagcatcttccactttgctgaccaaagcagctacttttcagttcaagctgacagcttgaatgaacatttgtttgattctttcctttcagtttggtcagatgatgactggttgaagaagttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatgaataatgaattcttagtactttggtaaagtcaatattgagttcttagtactttggtaaagtcaatatcgagtgaattcaagggcgaaactttgggtctcttgtccatgttgtgttctatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgggaacctgctggggcacttccccctgattctcagcatagtctctgacagttgcttcctgggcgtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtggagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggaggaagcagatgcatctgagggcaagcatgatgagataacacccccgtgtgtgaggctcaggttagccagtgctgagacctcctgtcgctgggcatccagctgggtgctacggccatggctcctgcctcctgcagccctatcagggcccaaggccttccccgtcagcacttgctccagcctacgcactggagttgtgttctgggtgggtgtgtagaatactcgcactcctacttagggcgtcagggagctctctctaactagcaatttcttctgcacctagggagagcccattgctaaaaaggcccgctcaaatcctcaggtgtacatggacatcaagattgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtacctcagccctcactatgcgtaggatgtcctagtccagagaccctctgctttaacctaccaaagactagacccccagctggctaccaggttggggaggggtggcccccagctgcagagtcagggaaaggatcccaaagattaaccactttcttaaatgggctttcagccaaacttactgtctccaggattacctgcaccctttcctctgagcttttggagtgcaaattgagttgcttcttggcttttaccagcttaagattcagctttctcgggtctgctatatcatttaggactcatctattttgttttctaacttcagaaattttgttgctgttgtctcttcctccctgctttttaagtttattttttggctattttagccactttaaagtgtttgttagcagtaattactctgttcgaaatttttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctcccgagtagctgggattacaggcgtctgccaccatgcccagccaattttttgtatttttagtagagacgaggtttcaccatgttggttggccaggctggtctcaaactcctgacctcatgattcgcctgcctcggcctcccatagtgctgggattacaggcgtgagccaccatgcctggcccacatcttctcttaacaggtgtgacatggcatctcattgtggtttttatttttattccctactgactaatgatgttgaacatcttttcatgtgcttgttgaccatttgtatatcttctttggagaaacatcttttcaaatctttggcttatttattaactggattgtttgttttgttttttttaagagacagggtcttgctctgactcccaggctggagtgcagtggtgagaacatggcttactgtagctttgaacccttgacctccagtgatcctcctgccttgacctcccaaagcactgggattacaccgtgcctggccattttgttgttgaattataggagttcattatatattctggatattaaacccatgttaaatatgatttgcaaataagcattctcctgttctgtgggttgctttgccctctattggtacggttctttgatgcacgtcttaaattttgataaaatctaattatttttttctttcacctctgcttttggtgtgacatttaagaaaccatcaccaaatccagagtcatgaagatttgcccctatgttttcttctaagatcctttggtttttcttttaaaaaatcagtttcctaccaatttagtgtggttttaaaagggaacagagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggttttttattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagcatgaaagcatgcagttatcaacctttaaaaaaaatcttcatccggttgccgggtgcagtggcttagtcctgtaatcccagcattttgggaggcagaggcaggcggatcacctgaggtcaggagttggaggccagcctaactaacatggagaaaccccatctctactaaaaatataaaattagccgggcttggtgggcgcgtgcctgttatcctagctgctcgaaaggctgaggcaggagaatcacttgaacctgggaggcggaggttgtgatgagccaagatcgcaccattgcactccagcctgggcaacaagagcgaaactccgtctcggaaaaaaaaaaacaaacttcatccttgtactcttgttccctctccagctatcacccatgcccctggtcccccatcttttttcaagaagtaaaagcataacttcttgaaaacatggtacagacttgctgccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcattatacttaccagttgagcatcccaaatctgaatatctcaaatctgaaatgctcgagtgagcagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctataccaatatctggcaggatatttgttgttttgttgttgtttggtttttgttttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccagagtgctgggattacaagcattagccactgcgcccagcctctagcaggatgtttgtaagggccaagaggatatgagacaattcattgtgccagacattgcagaacatctagcattccaggcccccacctgctaaatgccagtagcacccccacaatatttcagacagtcaaaaacactttcaggccaggcacggcggctcatgcctgtaatcccaacactttgggagtctgaagtggcagcccaaagccagaggatcacgtgagttcaggagttcgagaccagcctgggcaacatagtgagaccctatatctactgaaaaaagaataaaaaaattatccaggtgtggtggtgcacgcctgtagtctcagccgcttgggagttgaggtgagaggattgcttgtgccccagagattgaggctacagtgagctgtgatgcactcctgtactcagcctgggtgacagagtgatccccatctcaaaaaaagtaaattcagatttccaaaggtttcctagggacaggacaccaaccccactgagaagcagtgccctaagcagtcacacccggtcccagggctttcagcggtatctctgagttaagtttgtgcagactggcatctgcatgctgatggctccctgagctccagactcctgtccaactgcctgcctgttgtcttcactggatatcccacgagcatctcacactttacatgtctaaaacagctcttggccttctcccctaaactcttcctcctcctcttccctgtttcaataaatgactccaccatccacttagccgcttgatcagaaacttaggagtcattgtggacacacacacacatacatacatgtacacatacacacacagacacacacatatacatgtacattctcttacgtgacaaatgtccatgttaccaggcctcactgtgtcatagctgtcattttgaatggctcttttccactgattgtgagctccaccagagcttggactatgttctgctcatcagtgttcccagggcttaacagggacctggttgtcaagtagacacttaattgttaaataaatgaattaatgaaagaacagaccagtataaagtgattgaaacacctcacttaccatttcactgactattaactgaatccaagataaggtggccgcatttgcatgtgatctgtgcatccccgagtctgagcctgactggctgaagggctgtcaacagcctgcacagacgtcctttaagggctggtagccagggttcggggagctgatggttgttctctccctcaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctcacttctattctgccacaaaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgcctaatccagcccactgcctgtttttatgaatcaggttttattggaacacagccacgtccatttatttacatattgtccatggtggtttcttactgcagtggcagaggtgcgtaaggggctatagacacaatacaggctatggtccctgtattagggttttctagagaagcagaaccaatagggtgtgtatatatgtagaaagagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgttcacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcacctggctgcctcgggaaaactctgacctctctgggaagtggagccagtggctctgtgggcgtcctttcctgcagcctggagagcaaagcggctttccctgggactgtgtggctcctgtcccaactggcctccccattccacattcccattgctggaccagcaccaggactgggcacagggcttccttttgctgattcatttcccccctaactcattcagagttgagccccatctgagtccccacatgctggccctgaaacggttacaaaggctgaaaccagggatggcaggcccaggatcagtgctgtggctgttggagtgtcctctccaacagcatgacagccgcctccaggtgctcccagcatctgttgcagtcatggcagcctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaatagtgtgtttatttgacttgtgggactgtagtgatttgaattgtattttattttttatatatcccactttcctccaaaactgcattatttttttgagaagtgaaagacatttttgaaaaagggggtcaagtgcccatccagggttcctttcaaaaagggggccaagcagttgacctggatgggcagttcccccatgcaaattgccacccaagacacctggtgggtacagacctctctcagcaggacatgggatcccattgtctgggaacacagcaaagtttcacagccgctgccacaagtgacacttgctaggcctttaaaggctataagaatacaagtcccgccctctgagggatgccatgtgtagatggtttaggaaagagcacagctctgaaataaatacatcatcacctgcagaacacattttggtttaatggacagacatagaagtggctcaaaaataagcaaattcatttgtaataataccagcaaatacctattgttaagcatttatatgtcagacatcccaaagatttgtgtacatatttagtctttataatagctttgggaggaaagaaccaatatcatactctacaaaggaagaagcagaaccaggattcaaatctatttggcaccaaaaatctgcctcttgctacactgcctctattcctgtttctttggaccttttccagaacatgttacttccctgcctcagttagaagttagtgactacgaatcccctgctgacttggcctcaaggccagtattgcaccgcaaggaccaagactgctgggcattcctcttttgcctgttgtatgcgtcctctcttcctgtcaactgtcattgatttctcattgctgtcagtagatctgaaacaaccaccaccatcatccttccaaccctcatctggtgcaacgagataaacaggccatgccctgagcaaagaaaagggaaatggtggtatctgtgctgccagcctgggccacccactgcagatgcacatgcttggctcagcaaacggataaggattaaattcatggactttgtgttcattcacaattgtttcattgctcaagggatttttctattttatttcatttggtgactatctggatgataaaagttgctgaaagtctgatggccaactaggtagacaaagccttatgtttttccattgttctgtatgaaccaggaggatcacggctcgtattggttcctgctatgcacagcttgattaatgggtaaggtgtactccatatctacaaaccttcaggtagtttacagacattcttggtgcacccctaactatgccagatcattggctgggcactaaagatacaggtggagtaaaaaattaattgtcaaaataactggctaatttaaaatttacaattgcctagaagaccatctttgatgttaagaaggaacaattaagtaaatactaggatggcaaacaggttccataatttcattttgttgagacaacagttttgctcatgtcaccaggctgaagtgcaatgttgtgatctctgctcactgcaacctccacctcccaggttcaagcaattctgcctcagcctcctgagtagctgggattataggcatgcaccaccatgcccaggtaatcttgtatttttagtacagacggggtttcactgtgttggccaggatggtcttgaactcctgacttcaggtgatctgcctgccttggcctcccaaagtgctggggttataggtgtgagccaccatgc

SEQ ID NO: 13858 - DNA, 314 bp, Homo sapiens
aaaaaaaaaattagctgggcatggtgacgtgcacctgtactcccagctgctactcgggaggctaaggtgggaggatcatttgaggctgggaggttgaggctgcagtgaaccatgatcatgtcactgccttccagcctgggtaagagagcaagaccctgtctcaaagaaaaaaagaaaaaaaaaatcaccctggacaagtggattggaggaacagagccactatcaactcttccttagtctactacattaacttcctggtctcctgggttccaatcaacccatcctgggcctagtgtcagagcactgtctaaaat

SEQ ID NO: 13859 - DNA, 599 bp, Homo sapiens
aaatgtccatgctcttacatgtctttcctagatggcagaggcaaatgcaaagcaggaagacaagggaagataaatgccattggctttagccctaaatcatgctgttcactcagctttttcttgagttgactccacatgtctacctgtgaccagtggatcagtgcttcagatccatgaatatacaatacttcaggggttatccagttttataccccaccttgcacctcgggcaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggca

SEQ ID NO: 13860 - DNA, 5900 bp, Homo sapiens
cgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccaggtgcgttggaggggttctgggctccaggaggtttgggggagacaggcgaaggctgcgtggggggcacctgagggaggcggcctgcctgagccaggatcgagtcacaggatgttttgtggaccattgcgggctcgggagaccgggcaagtgggtccccagttccggggatctgtctgggtggttgggggagtgccgtgtagagggcaggggtcttcagcttggggggcctttgtagccggcgagaggcggaggagctccgcaagaggggaaggagaggaggcctgtgtcaggagggccctctggacgctgctggggagagtccggagtccagagggttgaggggaggggtggggagacgagatgtgtgtgaggagggggattggggcagggtggtggctccggggctgggatgatggggttctggcctcaggctggagactggggacttaggagagggagatcaggaaatgacctccttcaactgggggtcctacgtgtgagagactcagattgggtgacctgggcgaggagggcaggaacctggtctgtcctgtggataatttttttgatctaattatgtattgagaatcggccccacccagcccctggccagcggtgggctcatgtttgttgattgagtgaatgatttaattaacgcctgactctgctttttctccctcagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccctccctagccagacaggatgttgtcagaccccccgcctggctctgaatccttctttgagaactttctcaaaacttaggctgatgtttctcttctgtgagcctcattttctctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactgaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttattggcatcttattcgactaaggctacccatttctcttccttcgtgcaccaattgctctgattttaacatgtaaaggtccaactgcctggcctcctgggtgcctgcccagctcacagggctctattttgggacagttgaacccctcagggtgctgcagtcctgcctgcctctctcacctcccatctggacattattttaatgtaaaggcatggctgagacacagaaatccccttgaaatgtatcattgcggtcctcattgactcccattgtgtgccttaatggtgggcccagtgggtgggggctgggaggggtggagcaggtgcatggggcagcggtgcccagcacctgttccagtcacagctgctggcccactgcatggcaggcccctttaatccggggatatcgcatgtacagtgcccccctcggcgccctttgtccccgccggcctggtgccgatttcacacttgccaggagtaccatgaaggcgtctggggggcgagggatccaaggagtgggggtctgtgcctcctgcgtgtgcacacagcccccgcccccagcccatcatgtcctagaatgtctccttccccttttgtttgggttcaggtctcatcacactttgggcacttactgtacaggagggtagtgctcaggacttcaccaacagccctgggaagggaagggaggtgctgtcctaactctggtcttacaaatggactccagccccttttccagatctccagagtcagcccttagttcacaagggtgaacttacccttctcattcacatgaagacttagaatgcaatcaacaaacccttcaggcgtggcgtgtggaggctgctgagtaatggcagagtggagtagtgctcaggcacccctcccccaatcctctatgtcccccaccctttggagtggcgagtttccatttctgccccatgagactgagtccagctctcaggcgctccataagtccctattgaatgcatgggtcccattggagccatcctctggactctctcctaccctggtagctcagtgtggcaccctaggcacccaggaggtgatggaatgaattcactctcagctcttaaattccatccagcgctgggatttcacaggcgggccctgaccttgcgggcatatcagactgggcgtgaggggattggagaattgcatgttttttaaaaagactattcagtattatggaatagtgtctagcacttagtaggagctcagtagattaaaaaaaaaattatagacagggtcttgctttatcgcctaggcttgtctcaaactcctggcttcaagcaatcctgcctcactcggcctcccagagtgatgggattacaagcgtgagccaccacacccagcctcaatagatttttgtttaatgggttactgttatgaccttttatttggaaaatgctgcatcccccagaaaaaaacaaatcaacattattggtgtttttggaactatatagctttttggttggagcagggattgttatgaggcatgagtgagggggcagactcctctgaggcctctttaatttttaaaacagacttatttattctctaagggcttgttgaggatttactgggcacccagctccatgtgcaagacttttcccaacacagccttggccaggcagatggtgtgtcagggccacaggtttccgtagcctcttgggtgatagaaaggggcccaggccctgggctggggctcagaagggactcaaaggaggcccttgcccttatgggactcagcctgattggagaacagacaaggagatttgggattacagcgcaggaggtggggtggtgaggaaagcaggctgctggccgggccccaggagtggcctaaccagcttggaggtgggggtggggaagcctcttaaggctgactctggctttggcccccaacagagtaaatcaaggaatgactccaggactgatggtaaggacaccagtcacgtcctcccttgactgaaggcagtaagggcagtaggtgaaatcagaggctttggggtcctgccaggggaacctgaacatgctacttctgggcctcagtttcactgtctctgaaatgagaccacagtaggatcaagtgacagtaggatgaatcagtaaaggtgttgagtcattgttgaccacttcgcacgtccctgcgggatgtggatgagtaccctaccttctgtcacttatcaacccctatgagtggggggtgaatagccccattttacaggtgggaaaatggaggctcagagaagccagacaacttgctcagagttgcacagtgggaagcagcagagctccgtcaggtcccggcctttggaccctggctgtgtgtttgacggaggcctggctttcctgggatcatgggattctttcagggtttggggtatgcggggagggattcccatcactgccagccgttgtcccacggctcactcggcctttctggcgttctctccccaggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaa

SEQ ID NO: 13861 - DNA, 187 bp, Homo sapiens
tagaggagtgggtattttgaaaggtctttggtaagggaggaggggacaggaattcctgaagcttagatatttctgacacagccttaaatcttgtccttggaaacatcatagggctttggagtcctgggtgtcactgtcagggaccttatgagactgggttttcccgttggcctgggtgtcctgtctg

SEQ ID NO: 13862 - DNA, 15230 bp, Homo sapiens
gcaatttgaaggaatttcttttttcataaatttatttactaagaaataacactgaaatttcttctatgggcctggttagcaattttgtaatatttcttgtgtttgtgagtgactttctctttaaaaacaaagtcttatctgagtgttttgatttcccagtaactacaaagtttttgtaagacagttttgagttattttccctcaaatgcaatattgtgttgcatatattttaacaagtataaagatgtggataaaattgataccttttagaaaataaaggaaaacattgtcttttctttgtgattctgtttaacttctcagcattaagtgaaagataaaaatttgagtgatccttttcaatattttccacagggaagagacttccaccttaggatagtgttgcctgaagatttacaactgaagaatgcaaggtgatatggtgtttagttataaacgtgcatttttgcattttggtgggacaggcagtacatttggtataaattgattctagtgactagagttttgcctaaaatgcttattagtcatttgccccaaaagaaacatttctgatttttccaaaccaatgcagcatttgtaaatatttacctgttactaaagtgcttttaaacattagttctctcatttttaaaaaaatatttaaagcagtaaacagccattgtgtacacttcactaacaaatactgaacaggtatataaagggagaacaaaaggattagaaaactttttttccaacttttgactgatattattaatgtgtatattcattatatgagaagagtcacatcagttcagtcctggcttaaattaggtaccaacattgagtgctggtagatacaactagtcaggatatgagactgaaaatttaggtaccaccccaaatctcaattctgcctctaaatatttctggagaagaatggaggaaaaggaatccagagatatttatgagtagaattgagaggattttgtgaccaacagaagtgtagttaagagggaaaaaggaatagaggatgcttttcaaattcccggctcagatctctaagctagagaagaggtcacagatggaaaagtagaagagagattgttttaaggcatatttggtgtgaaataccaagaggagctatttagtaggtagtaatgtagtggtgtggaaatagagtgtgagacctggagtgcagatgtgtgtggaagttacaacagatgaaggatttgagaccttgattatgaatagactttttggtgctgtgtctagcggggtagaagagaaagccagtgacaagaccttggggcgtaccaacatttaaaggactggtcactaaagaggaacttacaaggagactaaggattgaccagagaagaggaaaacttgggcagcagagtctttcaagccaaataaagagaggcttaagcaaggcatggttagcaatgctgaggattacaaagagataggttagatgcaagtaagttttgtgtggtggcagaagccatttgtgttggatgagtgggaggaaagtataaagtattttgaagaaaaagaggtggttagagaatggtatgcattcaagaaggagttatgatgttctttaaagatatatatttgagcaagttaattcattaaggagaaaaaaactagcagaacataaattaaggataccacaataaagggataattaattgaagtcaccaagttggtagcaggggagagaaagcacattttgagcaggggttaccaatggacatttgaatgaactactctgccactaagagaggagatagggatggttatggggatttgaagaccaagaatggagagagttgtgacagtttgaaaaggccatgttggggaaaactcagagaggcttcctacttgtaggtaactaaaagtaattccttagaagagttacttaatagtatcgggagcacaacagaggtcagccagtaagtggatgaacattaacttatcacttcttatacaattaattagaagtatgtatctttctagccaggcttggtggtgggtgtctgtagtcccagctacttgagaggctgaggcgggagggtttcttgagcctaggagttcaggttgcagtcagctattctactgcactccagccagcctgagtgacagagcgagatcctgtctctaaaaaataaaaaataaaaataaaatgtatccttttagttatattaatcgggaatttgaagataatattgctacacatgctttttcaaatacatgtttgatacattatatttgatgatatattgttatcaaaactgttggttttatttaacctatcttggaaaagaatctacttcagtggaaaactttgcttcggatgtgttaaagttaaaaaacaagatgtactgtttgcatgtcatttactgattgcagttatttatattttgaaataaaattagtaccaacagtttgaagacaagactttgaacagtatcagtggtaaaaattttattaacttgtccaaattatgtttgtcattcttttgtatgtacatgcatgtttgtgttagcatacaaataagtttttaattctgaacaatgaataaaccattttgtctcattaaaattttagattattatgtagttggcagctgagaacaatacttagtggataccatcgaatagtacaacaggtaagtcctttttaaaaggtttatgttttcagtgaagataagaaattactaaatttattgttctttaaagacctgctttgcacaatgttgtaacaaactggtttaatagttgttaagttttgtaggtttcatctctgtgtgtttttaaatctcagtgtcctcaggagatctccaggcagcctttgtgttgaaatcgatttccatctttgagactttaggttcttcaaatgcattcacccttatccatatccatcacttcttcagtgatttttcttctgagactgaatggtggtgatagggaaaaaaaatcagacccatttagagctgtgggatatctgtggcaaaaatgggattttagtcctagattagcaacagaaaagatgtggcagaaataatttaggatcatgtgtacttgcataatgaggggagataaattaaaggctgcttagtgtgttaataggcaggattaatttctttattcttaatgtttaggttcctctacctgaaaattcctttaaagattagaaaaaaaaatcagttactgaagcaaaataatgacataatataattcttcttttagaaaaatagtttttagaattgcctttctttttatgctttatgcatttgtgtgtttttttcctgattttctatatttctgtgtcttaaaggcaggttattatctatgataactgacaatcacagtaactctcccataaagcattaaagctgcaaagaagtataggagataaactatttgatttatagaatgaaggttatcatcctggcaatataattacagaagtttttttaaggatatgttcaaattatttctgttttctttccatccctgtctccatccctttgactatttatattgtacactaaaatttaagaaatgcatctgttgacatattgaaatagcatgggaaaaaatggtttatgtagtctaatattaagatctattactctgtttttcaccagcaagttatcaagaggattcctagaaaaaaatcccaattatttatctttccttgccccccaattggttaggtagaacccagtgttaaagtcttctttttattttacagtcccagtgaatattactattcttttcttgtatcatttttaattttagtaaatatgggccagggagtcaacagactttttctgtaaagaaccagataataagtttttctggcttagtaagccataagatctctgttgcagctactcaattctgccgttatagcaaccatagacaagaggtaagtgaatgtgtatggctacatgccaataaaactttgtttacaaaaacagtattgagctggatttggcctctggactttagtttccagaccctgtcatttattgatcatctgtaataaactaaggggaaaatgcaatgtagaagaagggatagtcaaggatttgctctacacagacccactcaaagctatgttaagatgtgaatcatatgtgttcatgcattgttgaaaacaatgtaaaacttgagaatatttttttctgtagttattttaagaatgaaggatttctaggaaatggaatagtaactcttaaatatttattgtactttagagattatttccttttttgccattttattataacaggttttactttaatgaatgactgtctccattttgactaatatggattagttgtgagaggacaaaaatcacaattataggtagtttttaaggtcaagggaaaaataaaaaaaatgaccatattgttaattaataattgttaatttattgctgccactagattttaaaaattacatagagttgcctgatttttatattttatactcctcttcccactcacatcactcctatacctcttctttctctttttttttctcttcctcctcctcctcctcttctttctcttcttctttaaaaaaagtaatgatgaggttgttagatttgctagacatagtagtgatacagaagggcggcagggaagtgctgagtagagaaagatgggtccctggtgagggctccacccccgggcctgtgcccactgacctaggtgaggacaggcatttcccaagaccaccctggcctgccatacctccatcttgtgcctataaaaacccgagaccctagcaggcacacacacacacaagtggctggacgttgagagaaatatatcggtggaggaacacacaagtggctggacatcgagaggacatcgagagcatgtcaagagcacaccgatagacttcagcatgccggcaggccattgaccggcagaatgacgtggagttcgaccagggtggttggaggagagcctgggctgctgagcaacccgacgccaggggaaaaccgtctcccttctgtctcccacatctactgagagctacttgcacttaataaaaccttgcactcattctccaagcccacatgtgatccaatttttccagtacaccaaggcaggaaccacgggatacagaaagttctttgtccttgcaataaggcaggggtctaattgagctgactaacacaagctgcctatggatggctaaactaaaaaagcaccttgtaacacacacccactgggctttcagtagctgtaaacattcacccctagacactgctgtggggttggagctccacagcctgcccgtctgtatgctcccctagaggtttatgcagcggggcactgaagaagcaagccacactcccatcgcatgccctgcaagggggacaagggattcagtagtaaacagtgctcaagaaacagagtagtgtgaggttttaagtgacattctaacacagtttaatatatctcagcaaattagatttgaggacattaattactgtttcaaaatgaaattggtaggagtagtaaagttgatgaccgatacttcatttcttatagttttcagatgtagatatagctaatctttttttcacattcacttgggcctacatttttttacagttttagtggatagaatatttattgtgcaaatgaaattaattggaaatattttgatctagagaatgcagcactctcctgatctaatgagctttatgatggagttgaagatgcttttggtaagaattttttttttttctgacactgttaccatactgcaagtcttgatttcttttttgtaactcctttaaaaactgacattattagaatttgtcttcttaactctcagtcatttgatgttttcttttactgtgtacataaatatagatgacgcatttcttgaactgcatgagggacataactgttcgaaggaacctctttgattgtattataaactaggtattcttgacactagtgttgggcaggtggtgaagaaataaaatgtactcctggcctatcagcagagagtttaacatctaagaagagattaggtagtcctacttaaagatataatatgatgtataaataattttgtgtatagctacagatatctgaaaaacttattaggcttcattttatgtatactgttacatatgtactgtttaatcagtgttgcataaaatacttgattattcagtttatcctgtagacattttattattttcttaaaacccaagttcattttattacccaagttttcaacataaacaaaagaagagggaagattatagtgaatactgctgggcctgaccaaattttaacattttgccaatcttatttcctcttctacttttttagaagaaagacaccatagtattttaaaggaaattctggatattgtatgtatccctctgtaaatatgtcagtgtgtatctctttaacagctaagtgctttttatctgtttttaaatatattattataacctcaataaagttaataatttcttatagctgctttgtttgtattagtatgcaaacaaggtcctcacattatatttagttgataagtctcttaagccttatataagacttataaggtacttatgtataacatcatctctctcctctttacctcaccctttttattcatgccatgtatttgttgaataaaacaaattaggtgtcctataaaatcttctacattctggatttggcttgtaagatattcatggtttatcttttaacatattctactttctttgtaatctggcagttagatctagaggcttcagcagatttggattcatttgttcttatgagattacttggtgctctgtatttattatattacatgaggatccacgtggtatctgatggttccttggttcctgttttagtaaatttaagattgatcaataggtttagatccattcaatataaagtttcccatcagactgtcacctaatgattttagcctctaataacaatcattgcctgtatctaatgtttcattaggatttacaaatggtaattttaaaaattccatcatctgcatttattagttgaaaatcttctgtagagaacttctcatcagttgtttggttaatttgaggtacagcttatactggagagactggataagtgcttgtttcttttccttttaaaacagaaaccaatttttagaataatgagttggtgcctagcaactgtcacagggatctaaagtgtttttttttttaaagtatctttatgaactcatagatttttatatatttaattaatttttttattgtagtcattttctttttgatgcttaaattgtcccatttttttggtcagcacaagtcccttcatattggctctttatttaatataacccaagcttgtttgccttctgataccagttgccccaggttcatttattcattttattccgtaactgtaatcagccatttctccaaagaatcatgatttctttgtgggaaatagtatttggatgcctcaatctggaaacttgagtgtgcattgctgttacttgtaggttttttcagtggacaaaactgagaaaaaatactttttggaaagaatataattatgagtttgtattgatatttacaattcaaattggcattatagaatttttacttgtttgcttgtatcacttttactctgaaaatgctgttttctaatgttaacatcattgtagtatggttttttgttatgttctacttgttatatttcacttatgcttttcctgtctatgtgttgttagtttatataaaaattacaatactaatattgctaacaatggaaagttttgatatttctttgtgatccttgttgagaccattttattcctagcagcagctactacatattgataacttagttgctaggttgttttctggagtccttttttaatgctaataagaaccttctaaggtaggactttgattaaatgtgtgagattagaataatagtttaaaattaatttctaaagtttgaattttgatttatgagttcataaatcctaattaataagggttatcaaacttgattacaaattacatcaaaggccttaatgtaataaccttaaaaaggtaaagtgaacaagtgaagcatatttggtttacatctccttgacattggagaaaagtttgcaacatttattttatctttttattataattttaataaacaatacaaatacaaggagagactaagggaaccagagtaaaagtatagatatcatgtcccattaaactcttcttatcaaaaataacttcattaaattgtaagtcacagctctcttggccatgtaattttggagaaacacttattagtttaaaactaaaataaaattttgagatctctgatttacaatatctatttagtatatttattcaatttctgaataaaaatgaaatcctgtattttagctttcttcagaaattacggacaaatttggtgattttattgctcatttaagatagtatacctaaagatataagaattattagtgttaggctgtattgtaagtaatagggttcctatactataatcaccaataaatatgttgagagtgatgctcacatgaaatcagtagttattgaacttattcagaaaatgttgtaaatcttccatggagtttcctagtaattactgcatatagtgggagttcagtatatatttaacaagtgaacaattacctatatttaaaataatcctaagtggtaggttattttatttctattttagagctgagccactgaagcctaaggcctcaaaataggaattgttaaagtcagtatttaaaacttctgtttgtgaagcctttccgctatgtacctttgcctcttttctgtgaagaatatgttgcttctctgcttttgcctttttagctgttacggttctacagtaggagtaacttacctgactcagaatagaaggtagagtgtataaatgtcataaacctaagattgaaaagtgtttttactattatccaggtttatttttaccttcaatttttgtgaatagcaataattaatatttcagaataaaaacaaatcttgaaagaagtactatactatattaatgcattttatttaataactagtagagcacaatcttcatagtattaggttggtgcacaacctaaatacgaatttattttggtggaccatcagtctatttttaggcaacattagtcatttatattataaaaaaggcagcatatactttgtcttctaggagcttaccctctaattaaatccatattgatattctcagctgtacggatctgttttcccagttgttttttttttttcatcataaagcagattcagaacgaaattgaagtagttcccgttaatagttttggttttgaagtgctgttttgtaatatctgttctttctaatatgatctcaatttgatagtgtcctatcctggttaaaaaaaattgatatatacttaaaaaataagattaaacatatacttaaaagaataaaaattacaaccttttattaggattatatttttcagaagtgtttataattttcaacttgtccctatctactttcgttatttattgtagctgatttatttaattaattaattatttactttttgtaataccgtttgatacttcagaccatatgaacatctaagtaatttgtagatagatttatttttactttccaaataagctgtctatctaggttggtaacttcaaaataattggtaattttagcttcagcaattctagtgatgtttatgtgtcttgtaaaaaattttagttttggttgggagaacataaacattttaaagccttcatagataggcctagcaaggaacgggactgtaatctagccagatggatggcataatactccgacttacctgcttgaagaatagtacagagtataagtcagtgaaaaaaattagcatgtggatatttgttctgataatgagtttgtttgttaggatgtggttcataatggtatacaaatatgtcagtttaggtaatgtacttagagttcaggcctttctttagaggtactttttaaaaaatgtatatatcaaacatcatattcatgggaatagagccatagtgaagccttgaggatgaatttaataaaaattttttttttatctccgataggcataatagtccaggagaatattaaaatctcaagttattttcatggcataaaaattgacattttgcatgaccttcagtgcagtcctttaactttttcttgtctctttttcatgagcaggggaatgagtcagccagatttccgtaaaaaaacaggcacttttattaggcactaagaagataatgaaattatgttttgcaatcaggtattaacagttcattgtcttgcgttccacagctaattcaggttttcttcttttaaacaggaagttgccttaaagaatagacaagagctgtatgcactacctcctcctccccagttctactcaagccttattgaagagataggaactcttggttgggataagtatgtctgttttaaaatatgttttaaatgcctttgttttatatattttaacttaatgtatttctagttttagcagtttatacctgattttagtcaaagtgtttaattgtaactagagtatttgatccttattgttgctgtgaattaaagagagggatatcatcataaaaaattgccttacaaagtaaaatgctaaatataatttggaaaaaatgacatttttatgtacacagtaagatgttaccgtaatagatactttcactgaacatacaactgtattctaaattttccatgtttgaagagtaatgctgagacacatgaaagagactggaaaaattgcagtatttctggaataattgttatttttggttaatatacaatttggcatgtctaaatttacatatatataacattataagtgcttttgtaatttgagtggtaaattttagcaactagggtttgtaagaatcatccagctttctttgaaaaaaatgattttttttttaaaactgatgcataaagaaacttaagttcagtaaacgtgtatgcaagttgttaaaacttaatccacataccacctggaaaaagtatgtgatgatttgtttgctattcagtttctgaatttagcttccttcttagtgtggatactttgaaacattacatttattattaagtgtattataacctttctactttgagctaaagcaccagtaaaaatatgccaatttttagttcttatcacttttttttttttgagaccgagtctcgctctgttgcctaggctgattgcaagctccgcctcccgggttcacgccattcccctgcctcagcctcccgagtagctgggactacaggcgcctgccaccacgaccggctaattttttgtatttttagtagagacggggtttcaccgtgttagccaggatcggtctcgatctcctgacctcgtgatccgcccgcctcagcctcccaaagtgctgggattacaggcgtgagccaccacgcccggcaattcttatcacttcttaaccgttatcaatagtattttagtattcatttattatttccatttagattgccctattactaagataaatcgagggctaacttaggtacaatgtggaaggaatgtgcaatttttcaccactaagtttttcttaatatgttttaaacatcttattattcatctgttttttagctattttctatgagttggccttttgataactaacctaaaaagaaccagaaaatcaaatcgccatttaaaagagaacaaggaacatatcttaagtgcagaatatatgtcctttaatatattttataccattacctgataactaaagaaaaactaaatagagacttaaacatattttagagttccaaattgttcccatgtaaatttgtttctagaggtgataaaaatgcactgtgattattacagaaataagaattattttcgttgcctttgccttctacttccctttatattccttaaaaggcttttatttagaacagtttctcttcttatgtgtagatcaattttttcccttttgttttaaccactaaaatttgactgagtgggccatacctcttttggtgcacctatgtgcagagataggttagccattccttcagtcatgactttatgtagacttaattttttatgaatacttctttaccttaccgttttccttaccgcctccctgattaagagtcaaagtgtgtacgatctgtacttaagagccaagttatttaaatcctggtcttgataaaaattacagcctcggatttcaactgttaaaaccttactaaaatcgcgattgcatgtaatagtgtttcactgcagatggactgcttaaagtctctgtaatcttattttatatgttttctcagttttacccatggatattagaaccgagctactttattttgctctcttgtataattgctcttgaggatgccactgacttggattaaaggatgttgtatgaaatagtcctaagatatgcagtagggattttatgtttggatgtcttccattgtatgataatagcactatctttatgagaagccatgaaagaagttttattctgtttcagatgctagaaaagtcatgctttgcctgactatccaacctgccacttaatgaataatgtgaactatgtaattgactatgttctctttgacttggcctctaggaaatttagagtcaaatttttggcacactttttagagccatgctggatataggatttatatttctgtatgctaatcttacctgacttttgttctcctgtgattcttctcttcatatcaagggtacatgttatctctgtgactcatcactgttgatcttgatcttgattacctggtgaggtagtatttgtcgggtttctgcaccgtaaagttactgtttttttctctctctccacactttactctttggaagtcactatatgtagctcacacttcaggagtgggcagttacgctcacacctcctttagggcacagtatttacacagatttggaatttttctgctcagattttgttccctctcatttatttgttttttcagtcatttatttgaaatactatggactcatggatatttattttatactttgggttataatcaaatactattttattttcttgctcaatttgttctagctttggccattgagagctctttcagttggctcctgtgtccttttgacaggcctcatcattgtggatatatatatatatatatatatatatatatatattttttttttttttttttttttttttttttttagcatgtatttactttctggcactgaaagaaattttgtatatttcctgccctttcctagaatcagccatttttccaaggagtcctggttgcttttatttgtgagtggtattagaaactaggatgtgggcactatgggtgcttgttgctattggtgtgttgttgtttctaggccttcttagctgaaaaatggaaaacaaatgtgtttatactaactcgtgtacatacttgtaaatgtttttgtatataaccatttatatctgtattaaggtaaacatgattttatactgatgtctacaactccagtccattaccatatgtagttttgtagcccacttgcttggtatatctgaaatctcatactccaacagggagaaaccgagctcccattatctgttatccatttacttaattgttcagttgcagtatacgtgcagagcactatcagaattattaatctgtacctccatgggtgacaactttatcaactatacaatgcttatttttatagtttttttttttttgcctttataggcttcactcattttcagttacttaggttagaaccatttcctccacccacttcaatgtacttctttcccatatttgtaacacagattgttttgtcacattctctgtttcatcctacgttcattttaaaaaatgattttaggatctatagtgatgctgcctttttctttccacatgagttttttgtgcctttttaatttttcttaatcagttttgcaagagccatatcaattatttaagttttttcaaagacccaacttttagcgttgttaattttctctgttgtatatttttttatcattaatatctgcttattaagaatttaatttttttagatttgcttcctttgtaatttgttgagatggatatgtaggtcattgatttttttccagtttatcttactttattatatattaatttaaggctgtaaatttgtaagcaattttagcttgatcccgtaagttttgatgttatatttctattactatcagttaaaaatattaattttcattgtgatttcttttgacttatttagtatatctcttaattttcaaacaactggagatttttgggttattgagttccagtttaagtctacttttgtcagaaatcatccttttaattatctcaatactttgaagtttactgaggcttgctttatgacccagcaccttgtcaattttggtatgtgttctatttccacttaagaagagtatgtaatctcttgttgggtacagtgctttgcttttattcattcctcacatttattaattatgtgtgtcagatatccaatatgtttaatgatttattttttttttttgtccgcttgtcctgagagctctggagagagctgtgttaaattctcccaatatgattgtgaatttttggaattgtttttgttcctcaaaattttgctttatgtctatttgcagtcatgttattgggtacatacagatttataattgctatatcttccttgttggttttcccttttgttattaggacatgtttcttttcatctctagaaatattcttgtcttaatgtctactttgttataactacacaagctaattagttacatattttaaaaactgctctttaccatttgcatttttttaaaacagattttaatgctgtattgaaattcttcctctttttctctattttctttcatagttttaaaatatttttcttgctggcagccaccagaaactggaagaggcaaggaatagattctctcctagagcctccagagggagcacatctttgctgacaccttgatttttgcccagtgaacagatgtggaacccctggcctccagaactatgagagaataaattcctcttgttttagcca

SEQ ID NO: 13863 - DNA, 499 bp, Homo sapiens
ttttatcagcctactttagttgttcactgtagaagtgttggtctttagcaagctattccatttaggccagaaatagatgttacatataattgtaagtgtactatattatgatattgaggactggttgatatttattcatgagattaggctttatttattaagacattagtcttgagtaggatttgggatggttggagccttttaaataaaattaagcataacaatggtgaggagagacagggaagacaagcaaaaagttgagatgccctagcagcagttcctgctgaggttatgattagttttgaggcattgatgtcatggacctagtcattctttaggtatagattgatggaataaagaaatattattttgacttatcttcagatgcttaatgttaatatttgttttttagagcatagttggaaatgtagaaagggtttgtcaaggacagaggaaatgttctagttttatttctgttgtattgagatggtgagtttga

SEQ ID NO: 13864 - DNA, 2600 bp, Homo sapiens
ctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggtttatat

SEQ ID NO: 13865 - DNA, 518 bp, Homo sapiens
actatctcttgaacgtgaaaagttattgatgcagtgaggtcgaatgcacacctactgcttcctaagctctggaacatgaatctccttcctctgtcatctccccagaattggaacctccttaatccaaccatctcactattggtcagtctagtgattgagaaataggaaaagccacaggttgaaatgatgaaatgtcattacactgaaagataataccaaagtacaaagtcctaggcacagtcttgtcaattccctcttgtctaagtggtgtggcaaatattattgtcacttttcagagaaaactgaggtgtagagaaataaataaatgaagttttttacagtcattccacaagttactgagcaagtcttagaagccctgactccccaaaccacaaaatctcctttgataatcattgctgccataacaccttcttttactgctttcctccttgaatccagagaacacatatttataatcattttaagagcctgaggaaatgacttcagcctgtgcaaaa

SEQ ID NO: 13866 - DNA, 628 bp, Homo sapiens
ccttcgcaactgaaaagctgatggagctggattccctgtttgtaaaggcatgaattcctggtggctccaccccattcccccagcgtgcatgtggggccttagtgggctgcaggcatgtttaggcaagcccctgtgcaagttcccttatctgcacaaaacatctcatgtaaccatttgtgggactggtcagaagttcttccgggacccttccctactgtctgcctaaagcaagctggctaactcctttcattggttcatttcacttatatacactccccagcaatctcatatacctccacagttctcaaataccacatatatacagatgtttccaaatctaaacatctatcccaggtctctcttctgaccccaaaccttcatatccagccgtctactcaacagtctcctggattgctcagaggcacctcttaacatatgtaaaccagagggcaacactgacctccccaaacctgcctctcctcctttatgctgccctatcctatgaagattttttttaaaatcagggccgggcacggtagctcacgcctgtaatcccagcactttgggaggcctagacaggaggatcacttgagctcaggagttcgagaccagcctgggcaatgcggcg

SEQ ID NO: 13867 - DNA, 2204 bp, Homo sapiens
atcaggcctccaagaaccatgtccccttcagagaggattcctaagcttcctcctcttcctcctcttcttactgcaagggaaatacaagatcagtctggaatgggcttccagattcatacaacctcccccaggacacagattctgggagagagaagaggaaggcaggtttggagcctccaccaccaccagtttccctcacgccctcctctctcccttcccctctttctcaacttcctcctttccctctcttccttctatgatctgtccctgcccctctgtctcctcttcctttccttccttcctcccttttctcctcccttccttagcaggcagcaatgagcaggtggcactgaacttagattccaccatcacaggtgggtagatcttggctcacaagcctgtcattgactagctaagtagccctgattggaggagtcattttatttccctgagcctttgtttctcatctgcaacatggagattttactcaccaccgtggtgcagacaaagtaggacaaagtatcctttaacccagggcttgacacgtgacactcatcaaacattgctgagctctaatctgcatcaggatatggtaagtgtctactgggtgctgggacaaaaggtacagatgggagcaaggcagagatccctaaacagacctctgttgtgatctttgttgtaatacatggtaattatttgtttccaaaaagaggtggaaggagacatagatagcttctaccgccaggcattcaggcaccagctgtgaaggccttctgcacattgaaaaactcagagtagcctggtggctggaatgaaaagtcaacaccagttcccccagcaaaatatttctccattcagccttttcggctcattggtttgcctgaaatcagttgtttctccctggggaagcaatctttaaaatggtgaggagagtgtgcatctgatgtgcctgcacttgtgcctgtgaaacagggtaggctcagagctccgtgcaggcccatgaagtcccctcagagacaccagtgttgggttgtcatagggtcccagaaaatgcctgtctgcttcgtgagatttaggctgggtgcacagaggtttcacttggtgtgcctgacttatttaggggctgcctgaagtgccatgtgagaaaggaggctgagggcgttgggtttggaggaagagagcactagggtggattagcagtatctgctgcaagtggaatttggaggggatagaaatcgtgcgttcagcttatttggcatctctgggttggcctcactttggcagttggttcctgctggctgggctctgctcacacgcagtgagaggtctctcagaggctctttgttctgctgctggggatgccttgggaatgatgccctggggtgcactgccacatcccacacaaaaggtctccttagctggagagccttaccaggtgcatggaggggaagacgcggtaccataaagatgaggattcctctcaaagtaatatatgcattgaatgaaatgcctacttcagtaaggaatttcccaaagctttacaagctaattctaaaattcacatggaagagaggccagagaatagcttaaattactttgaacaaggaggggagacttagctgccagctattaaaatccattattaaggcactgatgttaaagaatcaccacacaaatagacaaacagacattggagcagaagacagggaacagaaagacgctcatatgtatctggataacattgacaggaaaatcaaattgtaatgtcacatacaggagtcttcatgaaggtaagatgtttaaaaacatttttaaaagtataaaacattgtttagaaatatacgcctttgtagtaaatgtgtaaaaacacgcattagaatgatgaacaccaaattccagagaaagggaatggatccctgtggggcacagagtgtgcattaactatgtttatgtctttaaaggaagaaaatatttgaagcagatatggcaaacggagaagattcatgaaagctggatggccggcgcatgagcgtttgcggtgtcatactttgtttccttatgtttgaaatattagcatggctgggcatggtggctcacgcctgtgatcctagcattttgggaggctgaagctgggggaacacttgaggtcaggagttcaagactagcctgggcaacatagtgagacctcatctccaaaaaaaaaa

SEQ ID NO: 13868 - DNA, 2204 bp, Homo sapiens; identical to SEQ ID NO: 13867

SEQ ID NO: 13869 - DNA, 2146 bp, Homo sapiens
gctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgagtaaagaaaacagagaaaggaactctctgtcatgttgtgggctggagggcagcattcacactggacaagtgcttcagaaagatccttctggcaggtagtgggcagaaaaatgagtgaagtcagagcgatcgactaggaatccactgaaagtggatttaaatgagaggtgatgaaaaactcagctacagctgggcgaggtggctcacacctgtgatcccagcattttgggaggccgaggtgggcggatcacaaggtcaggagtttaggaccagcctggccaacatggtgaaaccctgtctctactaaaacaaacaaacaaacaaaactctctctatatatatgtataatatattaatatattatagatctataatatattaatagaatgtattatagatatatattaatataatgtattatatatataaatataatatattatatataatattattttatatatatatatacacacacaaaaattagccaggtgtgatggcaggcacctgcagtcccagctactcgggagggtgaggcaggagaatcgcttaaactcaggagacagaggttgcagtgagctgaggtcacaccactgcactccagcctgggcgaaagagcaaaactctgtctcaaaaaaataaatgaataagaaaaaaagaaaagaaaaagaaaaactcagctacaacagagtgactggttataatttccctgcaaaactgctaattctctgatggagggacaagcgctgaatcaggttttgtttatctctgcagagtacctacattgttccctcttatgataggagctcaaacacatgttgatgaaagggagggaggaaggaagcaggcaggcccgcaggcccatgcccttcttttacagataaggagacagagctgggacgggtggaggagtgttcaaggacattcttggctagaaacttactatctaaaatagtaaagagacctctaaccattctgctgacaaacttataagcacaataagctttgaataacaaacactccgcaggtaaagttccatgacaacgattcttgttataaagttgtggtcttcatagagaagtgctttcctctctcaggcaggaaaagagttcctttaaaatagatcgaaatgctctgtgatgaataatacgaagcagtaaggccttcacctggcctgggtccaaataacaggttctattcaggtggctctgaaagcacctgattgtgtgctgtcgccactgtgggcagggcaagtccagcagaactttacaagtcttttgttctgccagcaagcagtaattggttctccaccccagtgtagtaaacttccagccacctgaatgaaattcacctaatttaacaaactgcacgagaagcaaagcaactcccggagcatacacaggtgtgaatattgtgcatctgtcttctctgtgattcctcttgtcttgaggcttccacacccctctggtccttggttcgtcctgtcccctcttctccagacccatcttcccatctactgcagacctggctctattgggtattgaatctgcttctctccacacctcagtttccccctttcacctagctcttccttttagcttctaaacatgctcaaggcttgcagcctaaaaatgaaaatactacaaactactctttattctgcttcttcccccactgtgtgccccttccagtcataagcgattctgcaaggaaccatctatactcagtctctaccatctcatttcttgctacatagcaaacaacgttctaagaattttacatatattgacttatggaagcctgacaacatcactgtgatgtaagtgctattgttatttacattttatggatgaggacaaggaggcactgaacagcaaagtatttgccctggatcaccaggatttgggcaaaggtatgctctgagacctttttccccgccttatgcccattacaaggtaccttgaatgaaaaaatacacaagaacattgcatgga

SEQ ID NO: 13870 - DNA, 2146 bp, Homo sapiens; identical to SEQ ID NO: 13869

SEQ ID NO: 13871 - DNA, 1811 bp, Homo sapiens
aacctagaaaacatccagtggattacagaatttcttccccatattcactcctcacttttacaattttcccacaatcctctacttcagtgggatgctgtgtctagtgattaaacaaaaatatagagctgtgcaatttgattttggcttccacaacgaatatctgaatccattccaaatgaaattttagatataacaaagacttgtcctaatcatactgaaatattggtgcacacctctctgcattagatttcacttttttaaaaaacccagtggacattgctataaataagatttatttggctacaaataacctgggatgttgcttattatgattgatgcctgctggtttgttcccaagctgagtgaaattgaacctcgtcctccctactcattttgatgactgaggctggtttataagaaaaggaagtttggagaagaaaaccgagattagaaaatatcatgttttggttggagataagaaccagggatggcaagtaccagtgtgtacaaatgtatttcacggagtttgaaggaacgcataatcaagagggaaaacaatttgtccttcattggacgtattatttggatttgggtgagcaacaaaatggaatgtggtctgttaggagcattctgtttgttcttttgtccctgatgtgatgaatcattgccacatgctagatggactcttcatatccaggttttgtccctcagggctgagcactgtattaaagagtttttgttgagtcatttaaccttagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctagtttgtaaatataaataaattacttgttttgtaaacttttgtaaagaatattttggtagaaatacttcaaacatattctttgggttatatttatacatatgtgaaataaatatactatcaaaaggttatattttatacaaaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctcaataagaaagcattccaggtttcaatccttgttttttgtcctgctcccaaattcttttttaaacccatagttcttgtgtcttatttgattcttctgctgtgcacattgtattggtccttgttgcatgtagtctactgtgtgttttccgattttataaggcagcatttctccatacaaaaagaaaaaaaatgatgtacatataaacgcttttgttgtatggctcctccatgttactgtatatatctgccagcacttcccagttacactcctgtgagtcagcttatttttaccctaacataaatagtatgttttgtagtagttatcaaatttaagagataaagcaatcagaatgtttggattttcttctatcttaatgtgaatttcataattaatgtctatttattcagctattcattaaaatacaggattctttgggaaaacatga

SEQ ID NO: 13872 - DNA, 1811 bp, Homo sapiens; identical to SEQ ID NO: 13871

SEQ ID NO: 13873 - DNA, 179 bp, Homo sapiens
gcaatttttcttttttgttttaagtcaaagactagaaagcagttttaagcaagtaattcggtcttggctttgtaattaagccctatgaagataaataactctgctctaagtgaatgcgctaatgttacctgcattactgtaaacgtaccataacggtaaagatttcaacttgtaaaaca

SEQ ID NO: 13874 - DNA, 1551 bp, Homo sapiens
ttttctcaggtggctcatccacaataagcttaaactctaaccaggctttggcaaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgca

SEQ ID NO: 13875 - DNA, 1550 bp, Homo sapiens
ttttctcaggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgca

SEQ ID NO: 13876 - DNA, 137 bp, Homo sapiens
tagtcccagctcctcgagaggctgaggcaggaaaatcacttgaacccgggaggcggaggttgcagtgagcccagactgcgccactgcactccagcctggcaacagagcgagactccatctcaaaaacaaaaaaaaaa

SEQ ID NO: 13877 - DNA, 1745 bp, Homo sapiens
cttagccctcacttctaagagtctgtaagatattcccacttgaggagcttgtcttcttcaatgctgtatctcagaaattaaactcctccttttctcacgccaaaccatctctcctcctggcttctctcctcttcatggggttgttcatctcccacacactcaggtcagaaaccttgctattgcctcccctctttccacgcccccacttttttctgctcatatcttgcccatcactcaatcctgcagattctttcttcatgcctttcattccttccttcccgtttctatggcccctactctgacccaaatcatattacctaatattgcttcatatttttacccaagagcttcgtcctatctctggttcccttggaagctccccaatgcctgcaggcaaatccagcccccttaaatttaccattcagtgcctcccataatccaaccttgatctgctcttctaactaaactttccccatacccaaatgaagccccagccagcctggtgtgctccccagtctctggcaagcctctgctcaagtcctgtgttctgtttggaatgccagccccatgcacttcaccagtcctacttactcctttaaggctcagtcggtgacccacccttttggaggacatctgagctccccatggcagcttctgggcttctttgcatcctgggatctcccagaatctatttttcaacctgatgctacattcctccacagcagggagatgccttttattttgttcttcttccttataccgtcaaattccaaggatagaaaattgcatttccctgggcctgtgaaaagggatccctccctccctgcacactcatgcctggctcacacggagtgagccagacagcgcttcctcattccccgcagtgggtgtcgcaacagccagttgcaactagaataggggccacatcccgagtctcttgaattcttgccctgtggttaggatgcccttcttgcctgtcctgaaggtggagatttcctacagccgagagagagggagtcagcagtctagggcaggaactccatcatttctttattaaaccactcctaactctctctaatctctgtgagtcttgcctttcccttttctctcctcctcctactgttgagtacaactaggccaggctgaatgagaggagaaagatggggaggaggaaagaagttaggcagccttggcagagggtgcaatgctccgggaaaatgggagagatttacaaggcagagattgacagtttttagtaacttgactttgacctccagtgtacacagacatagccttggctgctggactctgagctttctggccctgggaagctcgagatttgcaaacacttgttcgacaatcacctcgtttatctgcattgtcaccagtgcagcctctgagccctctccctgtctttacttgaccctgtatagaaaaatgctttcagggccaattgcagtgactcatgcctgtaatcccagcactctgggaggccaaggcgggcagatcacctgaagttgggagtttgagaccagcctgaccaacatggagaaaccccatctgtactaaaaataaaaaattagccggatattgtggcgcaggcctgtaatcccagctaccagggaagctgaggcaggagaatggcttgaacccagtaggcggaggttgcagtgagccaagatcatgccattacactccagcctagctgggcaaaagagcaaaacactgtctcaaaaaaaaaaaaa

SEQ ID NO: 13878 - DNA, 828 bp, Homo sapiens
aactgtaagatatttatttaactctaagttacttaaaggtaaataatgtgccataaaagaggcacgaagtgctatgagattgcagggcagagattccttctggctatggactctgggaatgcttcctggaggagacggcatttggcaaagctctgaaaggatagacaggatacactgtgggaacttgagatggtggctgtagtcaaagaagagtataaataacagcagagagatggagaggtgtggtttgagtgactcattttgggtggaaccaagagtggcaaaaggcaatcagagttgggggtggaacggaagataaggcttggacagggaggccaatgtgtttgggagttatcctggaagtcccagacagccatggggctttattctgaaggcagtaggagctgttgaccatgctgacttcggtggaggtgcgagggtcagattctggtgtgtagagtggatgagagtgaagagagcttgaattcgcaagggagcagataagagagtgttgtaatatttcaggcctcacacatctgaataaattgcgtaactcagatactttgcggtcctgtggagcatgcaggcatcccctggaggcttctactttctctgagctgaaattggttctttgatgaatttgagagatatataacttatgagaacatccatgagaaacccaccattcctcttcacctctgtcttccatattcttgattcccagcctggccgcttccccctgggcctcccctctgctaggagtgtgttaaatgccaagcctgtctcaacctctatctggcagcaccttgaagtatcaagtcaggaata

SEQ ID NO: 13879 - DNA, 552 bp, Homo sapiens
tgcaggtcatctggaattctttccgggtctcaggctcgtgaggtgctcattgtgtatgtgtcatgggagctggagaatggctgtaggtgcaaatggacttggaaaagaacaatgtcaaagtcgtaagtccagcctggggcatggcaggtttatgtatgtgtgagtggcgggaggggctgtagatttgaactccctgaaagaagatatgtgtaattcttaccaaagagtaaatgcatatgtttatgaaagaaagttcattgctatcatctggctctccaaggcacctgtgaccccaaaagattaagaacatctctcataagatattatcatccgttctacaaacctttcataaaaatgacctcaaacttgagctcctttttaattcagacaaactaggccataagccctgttgaggaaagaaccgtatctgtatggagagtcactgttacatcccaaggacacagcctggtacctgacacacagctggcattgagtacgtacaatgtgtgcctgatataaggcagctctgttctcccaataaggagggctgct

SEQ ID NO: 13880 - DNA, 38771 bp, Homo sapiens; identical to SEQ ID NO: 6652
  misc_feature (7892)..(9416): n equals a,t,g, or c

SEQ ID NO: 13881 - DNA, 997 bp, Homo sapiens
gggtaaattcccagagccctggcactcccgtggagcactcaggaaacgctccttcacccctcaattctgctctcacacaccccgtcacacatagactcacatacaccaagcagagaggagcaaagagaaggaccatgtaagacaatcacggacatggcgttagaaggaaactgagaaacgctctacaagagttcgatgtattacattatttttaatttagatgaaattcacataacacaaaatttaccattttaaagtgtacgtacacttcagtggcttttcatatattcacagtgttgtgcaaccactacccctatctagttcaaaaatattttcagttctcccctcctccagcatctgggaagcatccattcaccttccagctctgtggctttgcaggttctagacatttcatgtaaatgcagtcatataatatgtggctttttgtgtctggcttttttcatttagcataatgttttcaaggtttatccatgttgtaacatgtattcttttaaaaaaaattttaatgtgtaaaatatacatatcataacatttaccttttaatcattcataagtacacaaatcagtggcatgaggtggtcccttcccaatgttgtgctgtcatcaccactgtctgttttcagaactttgtcatcatcatccccaacagaaaccctgtacccattaaacagtaactcccggccagacgcggtggctcacgcctgtaatcccagtaattccagcactttgggaggccgaggtgggcggatcacaaggtcaggagatcgagcccatcctggccaacacggtgaaaccccgtctctactaaaaatacaaaaaattagccgggcatcgtggcgcacgcctgtagtcccagctactcgggaggctgaggcaggagaattgcttgaacccaagaagtggagattgcagtgagccaagatcacgccactgcactccaacctgggtgacagagtaagactgtccaaaaaaaaaa

SEQ ID NO: 13882 - DNA, 5088 bp, Homo sapiens; identical to SEQ ID NO: 7228
  misc_feature (5)..(304): n equals a,t,g, or c
  misc_feature (3943)..(4892): n equals a,t,g, or c

SEQ ID NO: 13883 - DNA, 5775 bp, Homo sapiens; identical to SEQ ID NO: 6656

SEQ ID NO: 13884 - DNA, 738 bp, Homo sapiens; identical to SEQ ID NO: 6657

SEQ ID NO: 13885 - DNA, 430 bp, Homo sapiens
caaaaaaatcactgactccccatgcccttcctccaagcccctgatatcttctattcaactttctgtctctatacgtttgcctattctaggtacctcacgtaggtgaaatcatacaatatgtgtgtggccttttgtgtctggcttctttcactcagcatgatgttttcaagtttcatccacactgtagcatctatcaatactcaatttctttttatggctacataatattctatctacttattatttttattctatgaacactgattgacagcttcatttctggagggccaccagtgtgctacacactttgcaggtccttcacctatattcttgtatttattccatttatttataaactaatggtccccattgtgcaggtgaggaacctgaaagccagagggaatagtgacttttccaaaggtcacattgc

SEQ ID NO: 13886 - DNA, 289 bp, Homo sapiens
ttttttttgttgagttagggtctcactgtattccccaggctggtctgaaactcctgggctcaagcgatcctcctgcctcagcctcccaagtagctgggactacaggtgcacaccactgcacctgcctggctgggggttgcctcgttagggtccccaggcccggaaggtcgcgtgcttgctattgctgccccgcagacccccatggcctgctggagctagggggcgccagaagccttacttctgtgtctctggccgatgaacaagagagcctggatactgctgcagagca

SEQ ID NO: 13887 - DNA, 228 bp, Homo sapiens; identical to SEQ ID NO: 7231

SEQ ID NO: 13888 - DNA, 5141 bp, Homo sapiens
tgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 13889 - DNA, 2236 bp, Homo sapiens; identical to SEQ ID NO: 11378
  misc_feature (996)..(1995): n equals a,t,g, or c

SEQ ID NO: 13890 - DNA, 102 bp, Homo sapiens; identical to SEQ ID NO: 6331

SEQ ID NO: 13891 - DNA, 109 bp, Homo sapiens; identical to SEQ ID NO: 7566

SEQ ID NO: 13892 - DNA, 108 bp, Homo sapiens; identical to SEQ ID NO: 7680

SEQ ID NO: 13893 - DNA, 115 bp, Homo sapiens; identical to SEQ ID NO: 11380

SEQ ID NO: 13894 - DNA, 7745 bp, Homo sapiens
gatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaaggtaatccttgattttgaaagcagtaaaataattctgtctgacaccttcttgttgacttgattgatatggtttgttcttcctttgctttccagctttcttccttggatgtgttcatcattggtgcagtagccaaagcgattgccaccacggtgacctatcccctgcagacggtacagtcaattctgagggtgagtgctggagttctcttcgcatttagtcaaacagcattcgaatacatgtagtctcttgatttaaaacaatgttaataaagcaataaagcagttagttggtataccagaatattccctatctgttttttttcttttctttttttgagacaggatctccctctgtcacccaggttggagtaccgtggtgcaccatgggtctctataccctcgacctcctaggttcaagcagtcctcctgcctcagctgcccaagtagctgagactacatacaccaccttgtccagctaatttaaaatttttttgtgtgaagatggggtctcaccatgttttccaggcttgtctcaaagtcctggactcaagcgatcctcccaccttggccttccaaagtgctgggattataggcatgaaccattgtgcctggcccccattttttcatttgtttgatattctgcttaactaggctggctgtcattggtttagaatgaagtttgcatttgtaatttcttaggtaacataatgtctcagaaaacacagatgtggagacaagttccttaaagacctcaggaaagcataagtttgcttccttctcattcaagttgattggtttggtgccccagcagggattatcctttacaaagtcagaggttaattcctttagttcactcaggaggaatgaatgatttagcttttttgaagcactctcaaacttctgttttttatttcattcagttatttatccattcaaatatttactaagcatccacactgtgggaggacctgggcatgcagtggtaaataaaagtcataatccctgcccttatggagctagtggaagagagaatgaacaggtaaacaagcaaaataaataggtaattacaaattgaaaaaagaactataaaggaaattatttactggagaggggcatggtggggctcttcttagatagcatgattggaggtgggcttctttgagaaggaatatttaaatcaagatgcaaaggagggtaaggccctagtggggcagagtggacgaaagtgcattccaggcagggggagcatgatgtgtgtgttagtccattctcatgctgctctaaaggactgcctgagactgggtaatttataaaggaaagaggtttaattgactcacatttcagcatggctggggggcctcaggaaacttacaatcatggtggaaggggaagcaaacatgtccttcttcacatggcggcagcaaggacaagtgcagggggaactcctcctataaaaccatcagatcggttgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaccatcagatctcatgagacttattcactaccacaagaacagtataggggaaaccacccccatgatttagttatctccacctggccctgcccttgacttgtggggattattacaattcaaggtgagatttggatggggacacagccaaaccatatcaatgtactaagaatttggtgtatcctagggactgaaagaaggcctctatggcagtagagtggctcagggtgagattgcaagagcagcagggaaactgtaggtgaggaatgtagatttttatcctcagcactttaagctgagaatatgtgatgggaagggctttaagctggggaatatgtgctgtgatttacaattgaagaagactgttgtggctattatgtggtgaattggtcagaaagctaagagagaaagccaggggcaatctagtaggaggccatttcagtaatacaggcaagagaggatggtggcctggaccacggtggtggcactggagaggagaggggtaggatgaggacagattcaagatctgttttggagaaaaatttcaaaaggcttgttgctagataaaataggggtggtagtgagaatattccagttcagaaaaattagtaccttctgttaaaagcatttttactaatatattattttaaaattggtacttaacataagggaattcagtagcatccttataaatgtattttaacacttttataatgtaaacacataatctgaagagcttagactgcagatgttctaaatgattcatttctcagaatttcttaaagaagtggaagttattaccatcaatatctaaatcatcatcctgggcatatttttttcttttgaggtagaattttccctatacctctctataaaatgaaaattattatgcttgcttcattgaaaaatttttcttaggccggacatggtggctcatgcctgtaatcccagaacttcgggaggccgaggtgggtggatcatttgaggtcaggaattcgagaccagcctggccaacatggtgaaaccacatctctgctaaaaatacaaaaattagccgggcgtggtggtacatgtctataatcccaactactcgggaggctgaggcaggagaatcacttgaacctgggaggtggaggttgcagtgagccaaaattgtgccattgcactccagcctgggtgacagagtgagaagatgtctcaaaaaaaaaaaaaaaggaaaaatttttcttattttcacttatttgattgaaatatttcactcagttgaaaaatacaggattaatgaaatctatggtactaattggataaatttattaatgtatgctataagatactactccaacataatatcctccccaggtaaaaatgaagattttaaaaaacagcaacagtacttttgttttttttccctctttcctcagtttgggcgtcatagactaaacccagaaaacagaacattgggaagtcttcggaatattctctatcttcttcaccaacgagtaaggtgagctttgtagatgcctcacattccgtgctctccttcagcagccatctctgccagggaggggttgcatttccctctctcacactactgccttggtggtggcaacctccaaaacctttcccttgcttgctgtgcttagacatttcccattttaggagcctagtacagtatgacagcattttgggaaattatggaaaagttcaggttcttattctttgttagttacaaatattcagaactccttcagaaagagaacccttctatacttcagtcaccctgagtgtgctttcatcagtggcatatcctatgatgcctcttagcaatataacatctgcctatagaataggagtactggagaagggagggggcagtggaaaaagtgataatagtgatgatgatgatgataatgatgatggtggtgttggtaagagtagctaacattttcagtggtttgccatgtggcagacactgacctagaggctacacataggtaatctcaatcctttttttttttttttttttttttggagacagagtctcgctctgttgcccgggctggagtgcagtggcgctatctccgctcacggcaagctccgcctcctgggttcacaccattctcctgcctcagcctcccaagtagctgggactacaggcgcctgccaccacgcctggctcattttttgtattttttagtagagatggggtttcactgtgtttgccaggatggtcttgatctcctgacctcgtgatctgcccttctcagcctcccaaagtgctgggattacaggtgtgagccaccgcgcccagccttgtcaatcctaacagtagctctgtgagttaagaactattgtcatttcctgtttcatttaaagaaactgacacttagtgaagtcagataagtcagggacctcctttgaagcaaaagctcttataactttattactgttcctagatacaagatactttgaaaataaatttattattaaaataaaatatgcagccaggcaaagtggctcatgcctgtaatcccaacactttggaaggctgagacaggaggatagcttgaggccaggagttcaagaccagcctgggcaaagtagtgagaccctgtctctacaaaaaatatttacaaaattagccaagcatgtggcacaaacctgtaatcacagctacacacgaggctgaagcaggagattcacttgagcccggcagattgaggctgtactgagctatgatggcaccactgtactccagcctgggctaaagaggcaagaccttgtataaaaaaaataaaaaaaaaaaaagaacattcaagggactaaaagacaaaattaggctgggcgtggtggctcacacctataatcccagcactttaggaggccaaggcaggcagatcgctttagctcaggagtttgatactggcctgggcaacatagtgagaccccgtctctacacaaataaaaaattagctaggcatcctggtgcctgcctgtagtcccagctacccaggaggctgaggtggaaggattgcttgaacccaggaggtcgaggctgcagtgagctgtgattgtgccactgcactctagcctgagcaacagagtgagaccttctatcaaaaaataaaataaaataaaagacaaagaatatgtataaagtaaaaaataaatactcactatatcaagtattgggagggatgttggagcaaccagaacttactttcttatgctgctggtgggaatatagaatggtacagctgctttggaaggcaatttggcattttctttaaaaatttttatataccacacctattataggacccagccatccacttcagggtatttacccaagagaaatgaaggcatatgtctacacaaaagcttgtatacaaatgttaataatggctttgtttttttttttttaattttttaatttttgatttttgtgggtacatagtaggtatatatttttgaggtatgtgagatgttttgatacaggcatgcaaagcataataatcacatcatggaaaatggggtatctatcctctcaaacatttattctttttgttacaaacagtcctattatactcttttagttatttttaaatgtacaattaaattattattgactatagtcacctgttgtgctagcaaatactaggtcttattcaaactatctatttttgtacctattaaccatccccaccttccccccgccactactcttcccagtagtctctggtaaccatccttctacctttatctccatgagttcaattgttttgatttttaggtccctcaaataagtgagaacatgcgatatttgtctttctgtgcctggtttgtttcacttagcagaatgacctccagttccatccatgttgttacaaacaacaaactctcattctttttgatggctgaatagtactgcattttgtataagtaccacattttctttatccatttatctgttgatggacatgtagcttgcttccaaatttaagacattatttgtaagaaccaaaaactagggcctggcacggtggctcacacctgtaatcccagcactttgggaggctgaggcgggcagatcacgaggtcaggggatcgagaccatcctggctaacatggtgaaaccccatctccactaaaaatacaaaaaaaaattagcctggtgtcgtggcgggtgcctctagtcccagctgctagggaggctgaggcaggagaatggcatgaactcgggaggcggagcttgcagtgagccgagatcgcgccactgcactccagcctgggcgacagagcgagactccgtctcaaaaaaaggaaagtactttgacaacagaagtctgtgttgaaatctaaaacctctattgcttgttcttatcaaagtagctatctaggtagcatgttctctgatgcaggagctgacttctgttttttcaaacctctttccctttagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatc

SEQ ID NO: 13895 - DNA, 98 bp, Homo sapiens
ttgagatggagtttcgcccttgttgcccaggctagagtgcaatggcacaatctcggctcaccgcaacctccgcctcccgggttcaagcaattctcctg

SEQ ID NO: 13896 - DNA, 116 bp, Homo sapiens
tttttttttttttggaaatggagtcttgctctgtcacccaggctggagtgcagtggcacaatcttggctcactgcaacctctgcctcccgggttcaagcaattctcctgcctcagc

SEQ ID NO: 13897 - DNA, 6218 bp, Homo sapiens
gaaatgaacaagttagctttttcacaacgggtttgctgccagaacacaggtgtcgtgaaaactacccctaaaagccaaaatgggaaaagaaaagactcatatcaacattgtcgtcattggacacgtagattcgggcaagtccaccacttctggccatctgatctacaaatgcggtggcatcgacaaaagaacaattgaaaaattgcagaaagaggctgctgagatgggaaagggctccttcaagtatgcctgagtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctggttgtgctgtcctaattgttgctgctggtgttggtgaatttgaagctggtatctccaagaatgggcagacccgagagcatgcccttctggcatatacactgggtgtgaaacaactaattgttgatgttaacaaaatggattccactgagccaccctacagccagaagagatatgaggaaattgttaaggaaatcagcacttacattaagaaaattggctacaaccccaacacagtagcatttgtgccaatttctggttagaatggtgacaacatgctggagccaagtgctaacatgccttggttcaagggatggaaagtcacccataaggatggcaatgccagtggaaccatgctgcttgaggctctggactgcatcctaccaccaactcgtccaactgacaagcccttgcgcctgcctctccaggatgtctacaaaattggtggtattggtactgttcttgttggccgagtggagactggtattctcaaacctggtatggtggtcacctttgctccagtcagcgttacaacagaagtaaaatctgtcgaaatgcaccatgaagctttgaatgaagctcttcctggggacaatatgggcttcaatgtcaagaatgtgtctgtcaaggatgttcatcgtggcaacgttgctggtgacagcaaaaatgacccaccaatggaagcagctggcttcactgctcaggtgattatcctgaaccatccgggccaaataagctctggctatgcacctgtattggattgccacacagctcacattgcatgcaagtttgctgagctgaaggaaaagattgatcgccgttctggtaaaaagctggaagatggccctaaattcttgaagtctggtgatgctgccattgctgatatggttcctggcaagcccatgtgtgttgagagcttctcagactatccacctttgggtcgctttactgttcatgatatgagacagacacttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataataatgcaacataaaaccttcagaaggaaaggagaatgttttgtggaccactttggttttctttttcgcatgcagcagttttaagttattagtttttaaaatcagtactttttaaatggaaacaacttgaccaaaaatttgtcacagaattttgagacccattaaaaaagtttaatgagaaaaaaaaaaaagaaatgaacaagttacttgaaaatataatttataaaaatgatacaaaaataagtagaacacctgaattgtctaattctatttaagaaatttattttatactggaaaaatcttcccgcagggaaatctccaagccaagagagatttactggggatatttctagacagttaaagaagaaataacactaactttacacaaattcctcaagaaatatttttaaaagaagggtaccgtttccaacttattttataagttcctcatagctttgataacagaactgaacaaagatatgacaaaaaaggaaactgacaggccaatagctctcataaagaaagatacacaatcttaaaattatcaaagtaaaaccagtgatctaaaagataatatatcatatccaagtggtttcatttgaaaaatgaagtttgtttacaaatactcaaaaatcaattaatttaaatttctataataaaacaaaaaggaacaaaattacatgataatttcattagattcaggaaaagcatttgatgaaatgcaacacatatttatgctttaaaaaataacttttaggaaataagaaatgcaaaggaactttcttactctgacaaaatctatgtctaaaaagacttaaacaaatattctacttaatggtaaaagactgaaagcaattaccttgagatactgaatgagtcaaggatacaatgtctaaatgtaagtgcaatgagagatgaaaaaaataagagcttaaagataagtaaaaaatctttcattcagaagttacacaatattgaacatagaaattcaaaaataatcttcataagtaaactattagacatattaggtaaaattagtagagtaaatatataaacactatatttctgcatactagctaaaaaagaaaataaattttaatggtactattaataatagtatcagaaacacaatatttataaaaataaattcaactaaattatgtaagacctctacacataaaattacaaagcattgttgggagaaattttaaaagcccgaaataaataaagggatataccatggtcattgattagaagtttcagtgtcgtagagatgttagtccttcctagattgattcagttcaatcctaatcaaattttcagcatgtttttgtgttagaatgtaggaaaattcaacatattaattcttaaatatatatgaaacttcaaaggactaagaaaatcaagacaattttgtttgtttgttttgaggcagggtctcactctgtcgccaaggctggagtgcaatggcgtggtcacggctgaccgtaaccctgacctcccatgctcaggtgatccttttacctcagtctcccaggtggctgggactacaggggcatgctactgtgcctgatttatttttgtattttttgtagagacagggttttactatgttggagaccacactggtctccaactcttgggctcaagcagtctgcctgccttggtctaccaaattgccaagtgtgagccacagtgcccagccccaggacaattttgaagcaaaaaaagatttattataatgttacaacaattaagataatatgatgtataaacacgataatcaattaatccagtgaaacagtactgagtcccaaaaggaatcacatgtttgcagttcactgaaagctggcaaagctgatactacaacccagtaaataaggaacactcttcccaggcacggtggctcatgtctgtaatcacagcactttgggaggccaacgcaggtggatcacctgaagtcaggtgtttgagaccagcctggccaacatggcgaaatcctgtccctactaaaaatacaaaaattagctggccgtggtggtgctgcctgtaatcccagctactcagccagctgaggcaggagaatcacttgaacccagaaggcagaggttgcagtgagctgagatcatgccactgcactccagcctgggcgacagagtgagactccacctcaaaaaaaaaaaaaaaaactctttataataagttgtggtaggtcatatgagattgggtatttatataaaaatatttatctatcttaaccccatgcttatactaccacaaaagtcaatagcagatgatcgcagacacaaatggaaggctaaaatacaaacacttctggaaaataatataagataatattttatgatgttgaggtaggcaaagatttcttaaacagaacataaaaagtgctactcaaaaaggaaaagactgatacattacatttaagtttagaacatccatttattaaatgcactagaagagaagaaaaattcaagtcatagaatgagagaaggtatttccaaaacatatatccaacaaataactcatacctggaatatattttttgaaaactgctacttgtcaataaagcaaatacagacaaaccaatataaaaataagcaaaacatttcaaaaaatgatatgcaaatagcagtaagtatatgacaagatactccactttgacagttatcaaggaaatgaaaattaaaaccactatgaagtacctctatattctcaccagaataactaaaataaaagggactgatttatcaaggatttggaggaactggcgctcccataaactgctggtgggtgtgctaattgacagaaccaccttggaaacaggtaccgtcaactaaagtcaatcacatatatagcttgcaattcagtaattctagttttagggatttactcctgaaaaatagatgcatatgtgcagaatagatatataacagtgttcctagcagcaccattcataatagtcaaaacttgcaaacaattcagagtattcattggcagtagaatcgataaataaattgtggtattggccgggcatggtggctcacacttgtaatctcagcactttgggtaacctaggcgggcagatcacctaaggtcaagagttcaggaccagcccggccaacaccgtgaaactccgtctctaccaaaaatacaaaaaattagcagagcatggtggcgcatgcctgtaatcctagctactcaggaggctgaagtaggagaatcacttgaacctggaaggtggaggttgcagtgagccgagatcatgccactgcactccagcctgggcaacagactctgtctcaaaaaaaatgtggtataatcatacaatcatgtactagaaagcaatgaaaatatatgaaatattgcctcaagttttccttgagtggctgaatttgatttaggttcttgtctcctcctatgtttatcaccctgtgtatgctaccataatagaacctgttagaatagacactttagtagtcactggtccaccagctatattctaggataagctgcaaacaattttttttgtggtcaagagctttatcttatatgactttgtatttatagagtcaaacttagccagtgcccaatgaattattattgaataaatgagtaaccagataaatttttaaaaaagaaatattgcctcatgcactaacatgattaattttaattataatattatgttttacaaacataagattgagcaaagaagtcagaaaccaaaaagagcattgtattatttaattatattaagttcaagaaaccggcaaaactaatctatgtggatgaaagtcagtatggtagtttttttggagcaatgattgggaaagtgtataaggagtgcttctgttgtgatggtcatagattatttcacgatctagatagttttaaataaacatgttcatattgtgacaattcactaagctgatgatttattcagtttaccgtgtgcaaatatttttgaatagatgagtaattaatttatctattaaatagaatagataaatgaatcaattaatatgtaaataaagaattggctcagccaaaaaagagccaattgtaaatattatgataaaatcaagagatgagtgaatttcaagaaagagtggacggttaacagtgcctattgctgaaaagttaaaaggcagtttttttaaggacactgtctgtgataatgaggaggatattgcctctctctggatacgcatcagttttgaggggttccagatttaggatgagatggtctcactctcacactactgattgctggtctaaagggggtgacagtgtttatgataaagaggtttattggtactgttaagtgtttggggtttggatttggggcagggggtttctctgttttttgtggagtttttaaatgaaattaaccaataaaattaacccaatagttcattgttcttttaaatagacacagtcccaaaaaagtctaattaaaacgtatctaggccaggtgtggtggctcaccctgtaaccccagtactttgagaggcagaggcagaagaatcacccaagagttcaagaccagcctgggcaagattgtgagatactctagctacaaaaaaaaaaaaaaaaaaaaaaaatttaaacatta

SEQ ID NO: 13898 - DNA, 1765 bp, Homo sapiens
gctttttcgcaacgggtttgccgccagaacacaggtgtcatgaaaactacccctaaaagccaaaatgggaaaggaaaagactcatatcaacattgtcgtcattggacacgtagattcgggcaagtccaccactactggccatctgatctataaatgcagtagcatcgacaaaagaaccattgaaaaatttgagaaggagactgctgagatgggaaagggctctttcaagtatggctgggtcttggataaactgaaagctgagcgtgaacgtggtatcaccattgatatctccttgtggaaatttgagaccagcaagtactatgtgactatcactgatgctccaggacacagagacttcatcaaaaacatgattacagggacatctcaggctgactgtgctgtcccgattgttgctgctggtgttggtgaatttgaagctggtatctctaagaatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattctcaaacccggtatggtggtcacctttgctccagtcaacgttacaacagaagtaaaatctgtcgaaatgcaccatgaagctttgggtgaagctcttcctggggacagtgtgggcttccatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgctggctatgcccctgtattggattgccacacggctcatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaaaggaa

SEQ ID NO: 13899 - DNA, 2470 bp, Homo sapiens
gagataccatctcacgccagttagaatgacgatcattaaaaagtcaggaaacttttttgtttttttctcaatgggtttgccaccagaacacaggtatcgtgaaaactacccctacctataagccagaacgagaaaggaaaagactcatatcaacactgtgatcatcggacacgtagattcgggcaagtccaccactactggccatctgatctacaaatgcggtggcgtcgacaaaagaaccatcgaaaaatttgagaaggaggctgctgagatgggaaagtgctccttcaagtatgcctgggtcttggataaactgaaagctgagcgtgaacatggtatcaccattgatatctctttgtggaaatttgagaccagcaagtactatgtgactatcattgatgccccaggacacagagacctcatcaaaaacatgattacagggacatctcaggctgactgtgctgtcttgattgttgctgctggttttggtgaatttgaagctggtatctccaagaatgggcagacccgagagcacgcccttctggcttacacactgggtgtgaaacaactaattgttggtgttaacaaaatggattccactgagccaccctacagccataagagatatgaggaaattgttaaggaagtcagcacttacattaagaaaattggccacaacaccgacacagtagcatttgtgccagtttctggttggaatggtgacaacacgctggagccaagtgctaacatgccttggttcaagggatggaaagtcacccgtaaggatggcaatgccagtggaaccacgctgcttgaggctcttgactgcatcctaccaccaactcgtccaactgacaagcccttgtgcctgcctctccaggatgtctacaaaattggtggtattggtactgttcctgttggctgagtggagactggtgttctcaaacctggtatggtggtcacctttgctccagtcaacgttgcaacagaagtaaaatctgttgaaatgcaccatgaagctttgagtgaagttcttcctggggacaatgtgggcttcaatgtcaagaatgtgtctgtcaaggatgttcgtcgtggcaacgttgctggtgacagcaaaaaggacccaccaatggaagcagctggcttcactgctcaggtgattatcctgaaccatccaggccaaataagtgctggctatgcccctgtattggattgccacacggctcacattgcatgcaagtttgctgagctgaaggaaaagactgatcgccattctggtaaaaagctggaagatggccctaaattcttgaagtctggtgatgctgccattgttgatatggttcctggcaagcccgtgtatgttgagagcttctcagactatccacctttgggtcgctttgctgttcatgatatcagacagacagttgcggtgggtgtcatcaaagcagtggacaagaaggctgctggagctggcaaggtcaccaagtctgcccagaaagctcagaaggctaaataaatattatccctactacctgccaccccactgttaatcagtggtggaagaatggtctcagaactgtttgtttcaattggccattgaagtttagtagtaaaagactggttaatgataacaatgcatcataaaaccttcagaaggaaaggagaatgttttgtggaccactttggttttctttctttgcatgtggcagttttaagttattagtttttaaaatcagtactttttactggaaacaacttgaccaaaaatttgtcacagaattttgagacccattaaaaaagtttaatgaaaaaataaaataaaataaaaaattaaaagttaggaaacaacagatgctggagaggatgtggagaaataggaaagcttttacattgttggtgggattgtaaattagttcaaccattgtggaagacagtgtggtggtttctcaaggatctagaaccagaaatatcatttgacccagcaatcccattactgggtatatacccaaaggattataaatcattctactgtaaagacacatgcacacgtatgtttattgcagcactgttcacaatagcaaagacttggaaccaacccaaatgcccattaatgatagactggataaagaagatgtggcacatatacaccatggaatactatgcagacataaaaaaggatgagttcatgtccttttcagggacctggatgaagctggaaaccatcattctcagcaaactaacacaggaacagaaaaccaaacaccacatgttctcactcataagtgggagttgaacaatgagaacacttggacacagggaggggaacatcacacactggggcctgtcgggggtgggggtgctaggggagagagagcattagcagaaatacctaatatagatgacgggttgataggtgcagcaaacctccgtggcacgtgtatacctatgtaacaaacctgcacattctgca

SEQ ID NO: 13900 - DNA, 2276 bp, Homo sapiens
atagcttttcgcaacaggtttgcaacagaacacaggtgtcatggaaactacccctaaaagccaaaatgggaaaggagaagactcatatcaacattgtcgtcaatggacacatagattcgggcaagtccacctctactggccatctgatctacaaatgtggtggcatcaacaaaagaagcattaagaaatttgagaagaaggctgctgagatgggaaagggctccttcaagtaagcctgggtcttggataaactgaaagctgagcgtgaatgtggtatcaccattgatacctccttgtggaaatttgagaccagcaagtactgaatgactatcattaatgcccctaaggaatgagaccaccacttctcctgttgtccttcccagcttctacccaaccttcccttttccctagtttataagacaggagaaaagggagaaagcaaaaagttggaaagaaacaaaagtaagataaatagctagacgactttggtgccaccacctggccctggtggttaaaataataataataatattaacccctgaccaaaactactggtgttatctgtaaattccagacattgtatgagaaagcactgtaaaactttttgttctgttagctgatgtatgtagcccccagtcacgttcctcatgcttacttgatctattatgaccctttcacatggaccccttagagttgtaagcccttaaaagggctaggaatttcttttttggggagtttggctcttaagacgcgagtctgccgacgctcccggccgaataaaaacttcttccttctttaatccggtgtctgaggagttttgtctgtgactcgtcctggtatatcccaggacacagagacttcatcacaaacatctttacagggacatctcaggctgactgtgctgtcctggttgttgctgctggtgttggtgaatttgaagctggtatctccaagaactggcagacctgagagcatgcccttctggcttacacattgggtgtgaaataactaatcactggtgttaacaaaatggattttattgagccaccctacaaccagaagagatatgaggaaatcattaaggaagtcagcactatattaagaaaattggctacaaccctgacacagtagcatttgtgccaatttctggttggaatagtgacaacatgctggagccaagtgctaacatgccttggttcaagggatggaaagtcacccgtaaggatggcaatgccagtggaaccatactgcttgaggctctggactgcatcctaccaccaactcgtccaactgacaagccctgcttctccaggatgtctacaaaattggtggtattggtactgttcctgatggccaagtggagactgttgctctcaaacctggtgtggtgatcacctttgctccagtcaacactacaactgaagtaaaatctgtcaaaatgcaccatgaagctttgagtgaagctttttctggggacaatgtgggcttccatgtcaagaatgtgtctgtcaaggatattcattgtagtaacaatgctggtaactgcaaaaatgacccaccaatggaagcagctggattcactgctcaggtgatctatcctgaaccatccaggccaagtcagtgctggctatgcccctgtactagattgccacatggctcacattgcatgcaagtttgctgagctgaaggaaaagattgatcgctcttctggtaaaaagctggaagacggccctaaattcttgaaatctggtgatgttgccatcattgatatggttcctggtaagcccatgtgtgttgagagcttctcagactatccacctctgggttgctttgctgcttgtgatatgagacagacagttgcactgggtgtcatcaaagcagcggacaagaaggcagctggagctggcaaggtcaccaagtatccccagaaagctcagaaggctaaatgaatattatccctaatacctgccaccctggtattaagcagtggtggaagaatggtcttagaactgtttgtttcagttggctatttaagtttagtagtaaaagactggttaatgataacaatgcatagtaaaactttcagaaggaaaggagaatgttttgtggaccactttggttttctcttttgcatgtggcagttttaatttattagtgtttaaaatcagtgctttttaatggaagcaacttgaccaaaaatttgtcacagaattttgagacccattaaaaaagtttaatgagaaaaaaaaaaaaagaaagtcacataaacagaatcc

SEQ ID NO: 13901 - DNA, 1819 bp, Homo sapiens
aaaagaatcaaaattttgacctttttcgcaacgggtttgccgccagaacacaggtgtcgtgaaaactacccctaaaagccaaaatgggaaaggaaaagactcatatcaacattgtcgtcattggacacgtagattcaggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagggacttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaatcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcatccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgtcgctggtgacagcaaaaatgacccaccaatggaagcagcgggcttcactgctcaggtgattatcctgaaccatccaggccaaataagcaccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaatggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaactggaccaaaaatttgtcacagaattttgagacccattaaaaaagttaaatgagaaaaaaaaaaaaagaatcaaaattttgaacagacacttcaactaaaatacatatgt

SEQ ID NO: 13902 - DNA, 2574 bp, Homo sapiens
aaaataaataaataataataatattttgctttttcgcaacgggtttgccgccagaacacaggtgtcgtgaaaactacccctaaaagccaaaatgggaaaggaaaagactcatgtcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatacctccttgtggaaatttgagaccagcaagtactatgtgactatcattgatgccccaggacacagagacttcatcaaaaacatgattacatggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgcccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaggttttaaaatcagtactttttaatggaaacaacttgaccaaaaatttgtcacagaagtttgagacccattaaaaaagttaaatgagaaaaaataataataataataataataataataataataataataattaataatattttgagaaactgccatactgtttccacagtggctgcaccatttacattcctctttttatgttttacacatctgctgtttggtgaaattttctacagagtagcttttaactctgagcgctgtacttcctttgaccctggacttcacgcccaaacatcagtaaactgtcacagaaggtagtaataatgtgtattcctggaagccatttctacatgggatgatcagtgataactattaaattaaatgactgcaagccacacatgcagtccattcaatccaaactaaatgcattcccaattcaacttcccctcagtcaaattccccaaatgcctgtgactgcttcagtgtctcccaacaccaggggacatgtgatagagggcaggtcccatagaaagagacagcaggctggctgtggtggcttacgcctgtaaccccagaactttgggagacggaggcaggcggatcatctgaggtcaggagttcgagatgagcctggccaacatggtgaaaccccgtctctactaaaaatacaaaaattatccgggtgtgtgtggtggtatgcctgtagttccagctactagggaggctgagtcaggagaatcacttgaactcaggaggtggagtttgcagtgagctgagatggcgccactgcactccagcctgggcaacagagcaagactctgtctcacaaaaaaaaaaaaaaaaaaaaaaaaaaaaaaaaaaaaagaaagaaaagaaaagaaaagaaa

SEQ ID NO: 13903 - DNA, 2480 bp, Homo sapiens
aaaccacaatgagataccatctcacgccagttagaatgacgatcattaaaaagtcaggaaacttttttgtttttttctcaatgggtttgccaccagaacacaggtatcgtgaaaactacccctacctataagccagaacgagaaaggaaaagactcatatcaacactgtgatcatcggacacgtagattcgggcaagtccaccactactggccatctgatctacaaatgcggtggcgtcgacaaaagaaccatcgaaaaatttgagaaggaggctgctgagatgggaaagtgctccttcaagtatgcctgggtcttggataaactgaaagctgagcgtgaacatggtatcaccattgatatctctttgtggcaatttgagaccagcaagtactatgtgactatcattgatgccccaggacacagagacctcatcaaaaacatgattacagggacatctcaggctgactgtgctgtcttgattgttgctgctggttttggtgaatttgaagctggtatctccaagaatgggcagacccgagagcatgcccttctggcttacacactgggtgtgaaacaactaattgttggtgttaacaaaatggattccactgagccaccctacagccataagagatatgaggaaattgttaaggaagtcagcacttacattaagaaaattggccacaacaccgacacagtagcatttgtgccagtttctggttggaatggtgacaacacgctggagccaagtgctaacatgccttggttcaagggatggaaagtcacccgtaaggatggcaatgccagtggaaccacgctgcttgaggctcttgactgcatcctaccaccaactcgtccaactgacaagcccttgtgcctgcctctccaggatgtctacaaaattggtggtattggtactgttcctgttggctgagtggagactggtgttctcaaacctggtatggtggtcacctttgctccagtcaacgttgcaacagaagtaaaatctgttgaaatgcaccatgaagctttgagtgaagttcttcctggggacaatgtgggcttcaatgtcaagaatgtgtctgtcaaggatgttcgtcgtggcaacgttgctggtgacagcaaaaaggacccaccaatggaagcagctggcttcactgctcaggtgattatcctgaaccatccaggccaaataagtgctggctatgcccctgtattggattgccacacggctcacattgcatgcaagtttgctgagctgaaggaaaagactgatcgccattctggtaaaaagctggaagatggccctaaattcttgaagtctggtgatgctgccattgttgatatggttcctggcaagcccgtgtatgttgagagcttctcagactatccacctttgggtcgctttgctgttcatgatatcagacagacagttgcggtgggtgtcatcaaagcagtggacaagaaggctgctggagctggcaaggtcaccaagtctgcccagaaagctcagaaggctaaataaatattatccctactacctgccaccccactgttaatcagtggtggaagaatggtctcagaactgtttgtttcaattggccattgaagtttagtagtaaaagactggttaatgataacaatgcatcataaaaccttcagaaggaaaggagaatgttttgtggaccactttggttttctttctttgcatgtggcagttttaagttattagtttttaaaatcagtactttttactggaaacaacttgaccaaaaatttgtcacagaattttgagacccattaaaaaagtttaatgaaaaaataaaataaaataaaaaattaaaagttaggaaacaacagatgctggagaggatgtggagaaataggaaagcttttacattgttggtgggattgtaaattagttcaaccattgtggaagacagtgtggtggtttctcaaggatctagaaccagaaatatcatttgacccagcaatcccattactgggtatatacccaaaggattataaatcattctactgtaaagacacatgcacacgtatgtttattgcagcactgttcacaatagcaaagacttggaaccaacccaaatgcccattaatgatagactggataaagaagatgtggcacatatacaccatggaatactatgcagacataaaaaaggatgagttcatgtccttttcagggacctggatgaagctggaaaccatcattctcagcaaactaacacaggaacagaaaaccaaacaccacatgttctcactcataagtgggagttgaacaatgagaacacttggacacagggaggggaacatcacacactggggcctgtcgggggtgggggtgctaggggagagagagcattagcagaaatacctaatatagatgacgggttgatgggtgcagcaaacctccgtggcacgtgtatacctatgtaacaaacctgcacattctgca

SEQ ID NO: 13904 - DNA, 1543 bp, Homo sapiens
ataaactgaaagctgagcgtgaacgtggtatcaccattgatatctccttgtggaaatttgagaccagcaagtactatgtgactatcactgatgctccaggacacagagacttcatcaaaaacatgattacagggacatctcaggctgactgtgctgtcccgattgttgctgctggtgttggtgaatttgaagctggtatctctaagaatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattcatcaaacccggtatggtggtcacctttgctccagtcaacgttacaacagaagtaaaatctgtcgaaatgcaccatgaagctttgggtgaagactcttcctggggacagtgatgggcgttccagtgtcaagaatagtgtcatgctacaaggaatgttctgtcgatggcaacgattgacatggctgacagcgaaaaatgacccaccaatggaagcagctggcttcactgctcaggtgattatcctgaaccataccaggccaaataagcgcgtggctatgccccatgtaattggattgtccacacggctacatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaaaggaa

SEQ ID NO: 13905 - DNA, 9086 bp, Homo sapiens
ctggcgacctgacgctgcggaggctcgagcggcgtatccataccacccagctgttcgccgcgggaacccgccggcccgcaggtgacccagcgctggaaaaacgccagcgacgtggcctggcgagctggcgcggggcaaggaccacccgcgcccgccttgccgccccagcctccctccctaggaagcagggtgcgccccggtgcgcgcggggcttccccggaccggcgttccagtccctctccggcttccgcccaccccggccccactgagagcagaaatgtgatctctgccctgagaaaatgctcgtggccagtgactacccctaacgcacaataatatggctccgatgggctcaaaggtattggttttttgttttgttttgagacaaggtctcactcggatgcccaggctggagtgcaattgcgtgatcttgactcactgcaacctccgcttcccgggctcaagcgattctcctgcctcagcctcccaagtagctgggattagcaggcatgcgccaccacgcccggctaattttgtattttcagtagacagggtttcaccatgttggccaggctggtctcgaactcctggcctcaaattatacgtccgcctcggcctcccaaggtgctggtattataggcgtgagccaccgcgcccggtccagtgttggttcttaaacgcgagaattgagatctcccttcacctaatgaaagtctcggccactatcgcaacattcagaacacccagtctgtgttgcacaatatgttacttaggtataaatcaaggattcatgtaattttgtcattccttgcgtgatattttaaaaaacattctgtgtaaggtatttataaagcgtttactattaccgcaatcacaggggcttgaggaaaaactttgactgtggcccgggcaccgtggctcacgcctgctaatcccagcactttgggagaccgagccgggtggatcacttgaggtcagcagttcgagaccagcctggccaacatggtgaaacccccgtctcttctaaaaatacaaaaatttgtggggcgcgcttgtagtcccagctacttgggaggctgaggcaggaggaatcgcttgaactcgggaggcagagcttgcagtgagccgagatcgcgccactgcactccagcctgggcaacagagtagaactccgtctcaacagaacgaaatacaaagaaagacagaaaatacaagtggactgtgaaaactgaaaggactagaaaaactacactacaaagatacagaaaccaagaaagcaccatagcgtttgccttcaactgcttcccaacttgttttcctcttccaatttgattgtggtttcctctccagaaggaactccacagtacttagcgttggccacatagtaggttctcaaatacttgttaataaataagtttgttcgagaagctgggcaatgatattctacagctggaagaagaaacataatgatctagtaattagctcattaaaaataaacgttcttctttcctcagaggagcatttcccaaggcctgccttgatagccatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgagatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagcggattcgtcgctttcacggccatcgagccgaacctctcgcaagtccgtgagccgttaaggaggcccccagtcccgacccttcgccccaagcccctcggggtccccgggcctggtactccttgccacacgggaggggcgcggaagccggggcggaggaggagccaaccccgggctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgaggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatccgacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaacgactcttaatccttacagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttattgcagaggctaaagtcatttgagactttggatttgcactgaatgcaaatcttttttccaaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaaggatgactacttaaatgtaaaaaagttgtgttaaagatgaaaaatacaactgaacagtactttgggtaataattaactttttttttaataggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattagcagcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaagatgaagtggcatttcttttaacagttactatgttggaattggttacaaattttggagtggatttcaaaagtgagagctaacttcagttgatttcaaggtagtgcttggctttttttgtttagacagggttttactcctgccctggttggagtggaagttaacggctaactgcagtcctgacttctgggcttaagtgatcttccctgaatagcagggaccacaggtttttgccaccacgcctggctaatttttgtattttgccatgttgccaaggctggtcaactcctgggctcaagtgatctgcctgtactgtatctttcccagttaatctgatatttatcttttaaatctcagatgtgccagggcctcggcagtgactcaaggaagaacccatgtgctcttagtgggacacgatttgttcagacctactaacctcaacccagtttcagttctttatagtggagaatgttgacagtttacactgacaggccacattttagcattgtgttatcttcatggttttttttcttttgagatgaagttccaaacttagtaacttaccatttactttttagtgtaattctaaaagatttcattcagctagaactaccctgatatttaactgtcctttttctcttacctaattattggcaattaaacatttttgtcatttactttgggactgtttttagcaggcccatggatctcaaggtttagttttgtgggttctatgggagacaatgacaatgaagataaacgttaatgttgcaataattctaagcaagggatattagaaaatgaagcaggccaggtcatggctcacgcctgtaattccaccattttgggaggctgaggtggggagatcacaaggtcaggagttcagaccagccttgctaatatgctgaaaccccatctctactgaaaatacaaaattagctgggtgtggtggcaggtgctatagttacgaggctgagcaagatcacaccactgcactccagcctgggcgaccagagaaagacttcatctc

SEQ ID NO: 13906 - DNA, 1766 bp, Homo sapiens
gctttttcgcaacgggtttgccgccagaacacaggtgtcatgaaaactacccctaaaagccaaaatgggaaaggaaaagactcatatcaacattgtcgtcattggacacgtagattcgggcaagtccaccactactggccatctgatctataaatgcagtagcatcgacaaaagaaccattgaaaaatttgagaaggagactgctgagatgggaaagggctctttcaagtatggctgggtcttggataaactgaaagctgagcgtgaacgtggtatcaccattgatatctccttgtggaaatttgagaccagcaagtactatgtgactatcactgatgctccaggacacagagacttcatcaaaaacatgattacagggacatctcaggctgactgtgctgtcccgattgttgctgctggtgttggtgaatttgaagctggtatctctaagaatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattctcaaacccggtatggtggtcacctttgctccagtcaacgttacaacagaagtaaaatctgtcgaaatgcaccatgaagctttgggtgaagctcttcctggggacagtgtgggcttccatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgctggctatgcccctgtattggattgccacacggctcatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaacttggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaaaggaa

SEQ ID NO: 13907 - DNA, 1273 bp, Homo sapiens
agaatgggcaaacccaagagcatgcccttctggcttacacactgggtgtgaaacaactaattgttggtgttaacaaaatggattctactgagccaccctacagccagaagatatatgaggaaaattgttaaggaagtcagcacttacattaagaaaattggctacaaccctgacacagtagcatttgtgccaatttctggttggaatggtgacaacatgctggagccaagtgctaacatgccttggaaccatgctgcttgaggctctggactgcatcctaccaccaactcgtccaactgacaagcccttgcacctgcctctccaggatgtctacaaaattggtggtattggtagtgttcctgttggccgagtggagactggtgttctcaaacctggtatggtggtcacctttgctccagtcaacgttacaacagaagtaaaatctgtcgaaatgcaccatgaagctttgagtgaagctcttcctggggacaatgtgggcttcaatgtcaagaatgtgtctgtcaaggatgttcgtcatggcaacgttgctggtgacagcaaaaatgacccaccaatggaagcagctggtttcactgctcaggtgattatcctgaaccatccaggccaaataagcactggctatgcccctgtattggattgccacacggctcatattgcatgcaagtttgctgagctgaaggaaaagattgatcaccgttctggtaaaaagctggaagatggccctaaattcttgaagtctgttgatgctgccattgttgatatggttcctggcaagcccatgtgtgttgagagcttctcggactatccatctttgggttgctttgctgttcgtgatatgagacagatagttacagtgggtgtcatcaaagcagtggacaagaagactgctggagctggcaaggtcaccaagtctgcccagaaagctcagaaggctaaatgaatattatccctaatacctgccaccccactcttaatcagtgatggaagaacagtctcagaactctgtttcaattggccatttaagtttagtagtaaaagactggttaatgataacaatgcatcgtaaaaccttcagaaggaaaggagaatgttctgtggaccactttggttttcttttttgcgtgtggcagttttaagttactagcttttaaaatcagccctttttaatggaaacaacttgaccaaaaatttgtcacagaattttgagacccatttaaaaagtttaatgaggaaaaaaaaggttgaaaaattg

SEQ ID NO: 13908 - DNA, 542 bp, Homo sapiens
tttccttatttcataagagtaaggtcataaactagctttataatcagctgagcaaatctccccattactaatggagttaagatgacagcatttctgttagtttgttccatgaaaatcttatagatgagcccaaaatctccaaagttctttatgcactgatggttatccctaagctttgtttctttgacaaatatatatggagtgcccaacatgtgtcctgggaagctaaaacacatttactgacattaatatcctcttgagaaagttctagaaatgttaagcaacaattactttgcattgtgctctctttatataactacttcattctctcaatacccaaatttctttctaaatggagggaggtagagtaaaattttatcctaagatttgagtatatgtgtatatacacaaatatatttgtgtatgtgttattcaaaaggactcagttcacactttgaaaccaaaccactgcaataggtaaaaagtaactttaattctattctgaaaagaacctcttctttaaacataggcataatttaatc

SEQ ID NO: 13909 - DNA, 305 bp, Homo sapiens
aggacatagtttcctcccctcaggatggctagccactgaagaaggaaaaatacttttgcctgcagctaaccaatggaaattacttaaaacccttcaccaaacctttcacttaggcattgatagcacccatcagacggccaaattattatttactggaccaggccttttcaaaactatcaagcagatagtcagggcctgtgaaatgtggcaaagaaataatcccctgcacttcaggccatacatttcaatccctgtatctttaacctccttgttaagtttttctctcccagaattgaaactgtaaa

SEQ ID NO: 13910 - DNA, 292 bp, Homo sapiens
gccaggtgtggtggctcacgcctgtaattccagcactttgggaggctgaggcaggcagatcacgaggtcaggagatcgagaccatcctggctaacacggtgaaaccccgtctctactaaaaatacaaaaaattagccgggcgtggtggcaggcacctgtagtcccagctactggggaggctgaggcaggagaatggcgtgaacccaggaggcggagcttgcagtgagccgaggttgtgcccctgcactccagcctgggtgacaaatcgagactccatctccaaaaaaaaaaa

SEQ ID NO: 13911 - DNA, 125 bp, Homo sapiens
acgcacctgtaatcccagatactcgggaggctgaggcacgagaatcacttgaacccaggaagcagaggttgcagtgacccaagatcatgccactgcactccagcctgggcaacagagcaagactc

SEQ ID NO: 13912 - DNA, 86 bp, Homo sapiens
agcctcctgagtagctgggattacaggtgcatgccaccatgcctggctaatttttgtatttttagtagagatggcgtttcaccatg

SEQ ID NO: 13913 - DNA, 6921 bp, Homo sapiens
tttttttttttttttttttttttttttagtagagatggggtttcactatgctggccaggctggtcttgaactcctggcctccagtgatccgccttcctcagcctcccaaagtgctgggattacaggcgtaagccattacgctccggtgcaaagaaaacatttttgaaagccctccttgtcttcagttagtagaggatcaatatccccccacccaagccccatcacagaagggcctccccagacagtattaagtattcaaggccccagacagaagtcaggtgtgggggttgtggggttgccagagtgtcaggccccccaccgcacgagatttggccctgtcaatcagccagtagccccttttttgccttgggacacctcagcagacaggacagctgtgtgatgttccccacgtctacaatcaggaagcaggggcggggcttcagctggatgctggggcaactgagggcggggactggcaagtccttagtgcttgagctgggaccataggtggcagggcacggtggcaccggccaccccctaacttccacaccgcttgcccctgctgcccagggaggatgtgagcctgtgtggacctagttgagaactcactctgtgacttccgggatctggatgcagcggctggggtcggcagggcccactgcagggaaacggttaaaatgcgctgggcttcgtttttcccggaagccctcattacctggtattaccttaggtgtggattcctttattcgcctgctgtctgtctctgccaatcaaatgtgagctccgtgagggcggaggggggcggtcctctcggcttcatcatccgagcccagcacaggatcgggcacatcgcggggagcatttggtaaatggatgtctgaatggctgctgtgaagtgaccggtcttagttcaggctactagaacaaaaatgtcatagactcgggggcttaaacaacagaaatttgtttctcacagttctggaggctgggaagtcccaggtcaaggtgcgggcagatacagggtctggcgaaggtcctcttcctggctggcaggcgaccgccttcttgctgtgacctcacacagcagagtggagtgagcacgcactcttgtctcctctatgagggcactaatcccgccacgagggctccacactcgtgacctcatcacctcccaaggcagcaactcctaataccagctcagggagttagagttttaacatatagtctggagagtgggtggggacaacacttgctgcaattcagccacccaggctgcgctgcgacatttacaccatgtgcccccagtgacggtcagtacctcaaagaggacccccagcctggaaatgggtggtctctggccccataggaggggtaaagaatgaagcggggaggcctgatttatagtgagtgagctccagtaacttaagagaagaaaacctgacctgcttatgccagaaaatgttatgactcggccctgcgcagtggctcacgcctgtaatgccagcattttgggaggctgaggcaggtggatcatggggtcaggagttcgagaccagtctggccaacatggtgaaaccccgtgtctaataaaaatacaaaaattagccaggtgaggtggcatcgtcctgcagtcccaactacttgggaggctgaggcaggataattgcttgaacctgggaggtggaggttgcagtgagccgagatcatgccactgtcctccagcctaggcaacagagcaagactccgtctcaaaaagaaaaagaaaaaaaaaaagaaaatgttatgacccaaaaataaattctggaaatgctctggaaattcaaggactccctgatctgtattcatctcctaaggtgactgtgagaaatcgccacacactgggtgactgaaaacacaacacaaatgtgattttcagagttctggaggccagcagtccggtagcaaggtgacagtaagatccaattccgccccccccccccccactcacgtcacaggaaattaaacatttaagctgaaaaaatgttcaaaccaagcagggcagtgcccatgcacagaagtgaggcccaacgggcgaagcggactcatcctccctcctcatgccaacagcagctcaaagcttctcaatggcaaaacttctaccaggtcctgtctaaggccaagattcctcctaaaacccaaaccatccccgagggggccagctcctcggtcccttcagcaggagggtccctgagtctggaaagaggagctcagctccaaggggtggtggtggaagatgcacccttctgtgtcttgtgccaggggtccccacctgtgggcagcaagccacccaggtgccaaggcaagagaccgagggcacaagctgttccagtataataaaatatataaaataacaagagttatactacatatagatcatagatatatgtaagtaccactaatcatcagtttgtagtaattactctttattcaactattataataatcctcgctctacaatcataacctaggaaaagccaggccatacagagataggagctgaagggacatggtgagaagtgaccagaagacaagagcatgagccctctgtcacacccagacagggccaccagagggctccttggtctagcggtaatgccagcgtctgggaagacgcccgtagccaagcggaccgtgttctagcagtagcatcagtgccaaggaaaagcaccggctacttagcagaccgggaaagggagtctccctttccctgggggagtttagagaagactctactccaccacctcttgttgagggcctgacccgcccacagttatccggaggcctaaccgtctccctgtgatgctgtgcttcagcggtcatgctcctggtccgctttcatgttccatcctgtacacctggctctgccttctagatagcagtagcaaaattagtgaaagcactaaaagtctctgatatgcagaaataatggtgtaagctgtctcctccctctctttctctccaccttggctgccaaatagggaagggccccctgtccagtggacacgtgacccacgttaccttacctatcattggaggtggctcacactccttaccctgcccgcttgtcttgtatccaataaataacagcacaggctggcattcggggccactaccagtctccacgtctcagtggtagtggtcccccaggcccagctgtcttttcttttatctctctgtcttgtgtctttatttctacgatctctcgtctccgcacaaggggagaaaaacccacagaccctgtagggctggtccctacatccaccctttccctgagcaacaaacgctggttgcagcacccaagcgtccttcaggagctccgaatctctcccgtgtggaagtggcacatagaggctgccccccacccccagtgtgcccaatccgcccataggaggtggctagagctgtagtgcccttctgtccagtgggatgaaatctgccaccccacagcagggcaagatgcgagaagcatgctgcgttagtctgttttctgctgttataacagaatatcccagactgggtaattcctacaggaaaaacatttgtttcttgtagttctggaagctgagaagttcaaggacacggtggcagcatctgctaagggtctttgcattcttgctgtgccataacatggtggagggcacatatgcaagagggcaggagagagagagccggagagagcttgcctctataacaaagagataagcaactcactcccacaacagcgacattaatccatgcatgagggcagagccaacattaatttattcatgagggcagacaaattaagtttccaacacatgaaatttgggggacattttcaaaccatagcatatgccctgaatccaggcagagaaagtgtcccctcagtgcacaaatattgtcacagctgcctgctctgaatgctgcaaggttttggagaacgttaaagctacttcttttttttttttttttttttttttgagatggagtctcactctgtcactcaggctggagtgcagtggcatgatctctgcacactgcaacctctgcctcctgggatcaagcgagactcctgcctcagcctcccgagtagctgagattacaggcatgtgctaccacatgtggctaatttttgtatttttagtagagatggggtttcactatgttggccaggctggtctcgaactcctgacctcaagtgatccacccgccttagcctcccaaagtgctgggattacaggcatgagccaccgctcccagccaaagctactttttaactgggttcctgatctttcttggcctgtctctgctcccagccttgccttactgctcctgcctctgacctcccgctttggatctcaggcaggaccaagtctaatctcaaaaagcttggtctgatgccctggggttggtcccttgtcttcccctcacactcagcccctcctcacttcctgtgcactaagggacactccttgtctgacaagccttgatttagtgtccctatgaccatgccctgacccggggctcgattgaaggctcaaataagacaagtggcctcattcagttgttcaataaatacttcctgagcacctgctctgtgctcagccccatgcaaagcagtggtgacagtgggaagacagtggtgaataagacagacatggtccctgtcttcagaaagttgccactcaggtggagaagtaaaaaagaaaaaaaataatagtgcttccggctccatgatgcagtgggtttggggccccgggcagcgaggatggcaccaaactagtgttttggggtcagggaggatttaccaggcaaattgaagtctaaggcaacaacctaaaggagaggagtagttagccaggtggtgggccagggatgctggggagtcactggaggcagggacagactgcgatctcattctggaaagatcactcttgcttcagtaaggaggaaaaatacagcagacaaactagagggtcactggattgcagggtgggctcactaaggttccaggtggcttggaatcagctttccaaattcagaaactcaatctcaatacccggaggtgggagtgccatatttagcaaattaaaaaatcacctagctaaatatgaatctcagataacacatatttagtataaatatgccccaaatattgcatgaattcaaatttaactgtgttcaatattttattggccaactctaccaacagtgaccaagtcttcatgactgtcttatgtgcaccaaactcacagggatctgatgtaaatacaccaatttattgatttacaattgcaggcaaggttaaaatatacatgttattcagtttctcctttctggaaaatgaaacaatcagaagactggtgaacatggaatgaggacaaaaggacacaaggaagtttgaaaggaaatttcatctcaaggcatggtaaattctggagaatcatcctggcctccctacagagaatcctctttggtggcagaaagtgcaggtcccccctggagagggcaggtcagggaccaccgggtcctcgtgtgcagctccctgtggaaacacgtggttcttctagctcaaccatcatctgctggtggttgatttcccactgtactctcaggaggtgttctttcaaagctttggggctcctgacccagccttccaattacaatacaatatatttcacattgaggttacactttagaatgtattcagtgggctgaattcacgtagctatttattctgccttcttaaacccaaggagagcaatcaggtactcttctgattaagaaatcacaggctgggcacggtggctcacgcctgtaatctcagcattttgggaggccgaggtgggcagatcatgatgtcaggagatcgagaccatcctggccaacatggtgaaaccccatctctactaaaaatacaaaaattagctgggcgtggtggcgcatgcctataatcccagctacccgggagtttgaggcaggagaatcgcttgtaccagggagtcggaggttgcagtgagccgagattgtgctactgcattccagcctggtgacagagtgaggctccgtctcaaaacaaacaaacaacaaaaagaaatgactttaggcaacatagtgagaccccgtcgccacacacacacaaatacaaaattagtcgggtatggtggtgcacgcctgtagtcccaactactcaggaggctgaggcaggaggatcacttgagcccaggagttcggggctgcagtgagccatgatcacaccactacactccagcctgggtgacagagggagatcgtgtctttcaaaaaaaaaaatcacttcagaaacggggtacccatacccaaggggtcacttgctcttactaatttctagctgtaatgcaagtggcatgatcatagctcactgcagcctccaactccagggctcaaaggatcctcctgcctcagccttttgagtagttgggactactgtggcatgcaccaccatggccggctaattttgtattttttggtagaaatggggtcttcccctgttgcccaggctggcctccaactgctgggctcaactgatcctcccgcctcagcctcccaaagtgctgggattacaggcgtgagccactgtgctgggccatgattctcatctcccaatattctcaaacccagtcccttcatctcttgactggattatgcagtctcggagctggtttatctgaactcactttctccccctttgatctgttctccacacaacagccagagaggtctttcaaatgcatgaatgggatcactgctccgcataaaacccttcaaggggccaggcgcggtggctcacgcctgtaatcccaggacttggggaggccgaagcaggcggatcacttcaggtcaggagttcaagaccagcctggc

SEQ ID NO: 13914 - DNA, 305 bp, Homo sapiens
aggacatagtttcctcccctcaggatggctagccactgaagaaggaaaaatacttttgcctgcagctaaccaatggaaattacttaaaacccttcaccaaacctttcacttaggcattgatagcacccatcagacggccaaattattatttactggaccaggccttttcaaaactatcaagcagatagtcagggcctgtgaaatgtggcaaagaaataatcccctgcacttcaggccatacatttcaatccctgtatctttaacctccttgttaagtttgtctctcccagaattgaaactgtaaa

SEQ ID NO: 13915 - DNA, 184 bp, Homo sapiens
gcagtggctcacgcctgtaatcccagcactttgggaggccgaggtgggcggatcacaaggtcaggagatcgagaccatcctggctaaaacggtgaagcccccgtttctactaaaaataaaaattagccgggcatggtggtgggcgcctgtagtcccagctactcgggaggctgaggcaggagaa

SEQ ID NO: 13916 - DNA, 24413 bp, Homo sapiens; identical to SEQ ID NO: 7346

SEQ ID NO: 13917 - DNA, 24533 bp, Homo sapiens; identical to SEQ ID NO: 7347

SEQ ID NO: 13918 - DNA, 490 bp, Homo sapiens; identical to SEQ ID NO: 7348

SEQ ID NO: 13919 - DNA, 318 bp, Homo sapiens; identical to SEQ ID NO: 7349

SEQ ID NO: 13920 - DNA, 4938 bp, Homo sapiens
tttttttttttttttgagatggagtctcactctgttgcccaggctggagtacagtggcgtgatctcagctcactgcaacctccgcctcccgggttcaagcgattctcctgcctcagcctcacacgtagctgggattacaggtgcgtatcaccatgtccagctaatttttgtgttttagtagagatgggagtctcactatgttggccagactggtctcgaactcctgacctcaagtgatccgcctgccttggcctcccaaagtgctgggattataggcatgagcccccgtgcctggctaaacccaaatttttattaaaatgcaaatataaattctaggttaacccatattttttttctctgagcagaaaatagcagatttcaatgggttacattttgactcttaaatataataatgccattttgcctcagaagagagatttttaaaaattacctttgtggaactacatattttggaaggaaaggaaagcaagatgctgaggaggaaagtgggatttctgatctttattcttccccgggaaagaccttgtcactaaatatcaacaataatttccgcattacattaggaagagttggaatagcagcacagtctcctgcagtctcaatgcaaggtttttcacaactcatgttcactgagaactaacggctgtttacactcttgggtaacacaaatgcattcatgaaaaccagacggctacataaatgtctcaggaggcaggagaatgggctattttgaaaattagccctgactcaaaactggctgtagaaaatcattctctcctcacctaattcatagatgtgccagaagggcccgacccccagagcccctctgggatcagagcaagtttcaatgaacatttgtataacaactagaaaaggaagctgcaaatatttatgaataaactgcagcaagtattctctcctgctatggagtctcaccataaaattagggagcttgatattacagggtgacaacaacccctcccagttttccctgaacagaaatgttgcccgggagcaagattttccatcgtaaaactgacagaatggggcaaatcaggacacttgattgccctaaccttgacagtaaggcctgtccatttctgattacaagtattttgagcctactgagttagcattacttagttacaaagctgctcttctgctgtagaaaatggggatgtcctgggatcctaaattttggcattggggctaggagtggggaaaactattaggagtgggagacaggggaaagtattggtcagtatttcaggagaagaaagaggccatgctacgtttaaaaaattaaaattaaaatatttatttaaatataattagtccataaactgccctagtgccctggccatcccctccctctccctctctttcaactcttagtgtcaggctacactttttcctggaagcctgacttccaattcaactaagtatcatacgcaaatgttggtggaggtaccttacagagatgatcttaaggtttccccatccctggacttcccagcatacactcatctgacattgactagggaacagtttagcaggaagatggattcaaagctcttgggttaagaattcttccccttacttgttctttatcaggcaatgacctagcccactgtcatcttgcacttgcctatccgtcaaatgggacaataaagatatccttggggtcagggtgctagtgaaagccagggtccacctttacactttttgatgctctgagtaggtactgcatgccacagaaacattaaaactcagaaactaatatcctatgcagtcttggagattgaatttgttcctatgaaggttcccatttctcaccatgtgagttatggttggggaaggacctgaaactgggagtggactgtgaaaggctgcactggagaagaggacttacagtgtcagtgagttgtgttctctctgttcctctttagagataggctggaggcatgtatagcttggcttccataatgcagataaaaaaatatttttccctaagtgttttccttgccttagtgtcttcttgctgtttctgcctggacttggagagattacaactatcgaattgagaataccagaagcaacacaagttgtaacttagagacacagagcttacgtggctgcaaatactttgtagtgtaagcgctgacatacctcagttttggagccaaagagtcacttttggtcacttctagaggtgtgatcttaggcaatttgctcaacctctctatgcttcggtttcctcatctgaaagatgaagatcataaaagtaaccatcccacagggttatcatgagaatcaataaaagaatctatgtggagtgcattgcataggaccagctccacaatgctctatatttcattatgttcccttgcacttacaaaagatgacggactgttcgtgatggcacagatacagactatcacattcaggacttaggtccatggctctcaaccctagagagcatttataaaactactaaggccttagccttacctcagaccagttaaattacaattactggagaacagggcctaggcctcaatatatttcttaagctccacaggtgattctcaagagcaaccaagattgagaactgctgatgcattggactctgttggttgtgtctttaggacctaatagcaatcatcagttgtgtgcttggtccgcaggggattctgctaagactgtcaggccatacagggtgtgggcctagttctgggagaatggttttcaatttgactcacacctggggctggtaaatcttcagtgggtgcatcacagagtagggcaacaaggctccctgagagttgagagaagggagtgggagcaaataggaggtaacccccctattccttaattttaaaaatgaaaaatcagagagctaagagtttggagttctaaggtaaagtccaaactggggcacatactcccacttgggtaaaaagaaggaaccaacctgcaaatcagaccaaaaccgcagatgcgcagctgggaaactagacacgaactcatcatatccaacactgaaagatagctcagatttctcttgcatggccttcaaagcaggagatggttctcgagcctcctatgaactagagcgcaatctcttaagaatgattatacaggtcagctgtggtggttcacacctgtaatcccagaactttgggaagttgatgcgggaggatcttttgagctcaggaattcgaggctgcagtgagctaggatcatgccactgcattccagtctgggtgacagaggaagaccctgtctctaaaaaaaaaaaaaaaaagagagagagagaaagaaaaagaattatcatatagctttggggagctggtttagcttctttagattaatgacagatatttggacttgcactaagctatcacctgcatattaaagcagtgggatttatttgtccttctctgagcttctgtttccccaactttaaaataggaatagtaatacctaccccttactttcctcaaagggaatttgtgatgataaacagaaataatgttccacataaaactcagtttgagctcctacaaagaaaaaggcatgacttaaatcaagataatattattgtcctggaggaaggtgctggaacaagttattatttttattcttatcaaagaactgtctttctgggcaaagcacaaagtttccccaggagagatttctctcaagtattatccagtaaatcccaacattccatttcttctaatgagccacacattaaaacttgctgccaaggtctataaggcaccccacagtagtaagatggtcaaaaaaaaagtttatgttaaccccaaaatgagttccaatctaccccctaacatgttcaataatggttccagtgccgtgacccactttggatgccttgctgtggtgagctgtgtatgcatttcacacatctgtgcttgctattgttctccaggccactgacactcttctacaaggctagtttaacaaccctatggggttttttattattggaaataacattgagtctatagcctccccagctgaatcttaaatacttctttcttttccataatggactgtcccagtattattaaactgtaaccctttttttgggaatacctttcacatctcttcaaaatttgcttttttttctacttaagctcactatttcttttaaactaactgttctttccatagactcttattagcatttcaaacctgataatatattacagctttgaggcacatcaggtcttttgtgtagcctgtctcccaaaatgttcccaagaattaaaacaagggaacaaacaatgcactctaatttgttgaaaattctgctctgcaaaatttaggtatgcaatatgactaaaacctgaatgggaaggagaggcagaagttcagaggaaagtataaaatgtgaatatttttgaagaaatgagaagtcagggaggtgaaagatggcaggaaaagaaatgtttgtatacatagggacaaagcaatgattactcaatggacacaatgctaattttggtgggatgattaaaacaaatataagatcgtcacaatcttgtgtgtgtgtccactttgggggagtctccagtcagcagatgacaatctgctgatggatctttctaaattgttaataaccataaccctttttttcttttttttgagacagagtttcacttttattgcccaggctggaatgcagtggtactatctcagctcaccgcaacatccacctcccaggttcaagcgattctcctgcctcaggctcccaagtagctgggattacaggcagccacaaccacgcccagctaattttgtatttttagtagagacagggtttctccatgttggtcaggctagtctcaaactcctgacctcaggtgatctgcctgcctcagcctc

SEQ ID NO: 13921 - DNA, 258 bp, Homo sapiens
actttcagcagaacttggaaaagccatcatttcacttggttttactttccccagcctttgaaaagtggagctagaaatagctcagaataggacagtcacgccgatttggcaatgagaggccactgcataaagacttaaatattaggaccttcaatctgtaaatgtggtagtggataagttgaaaactgatatgtgccttaaattctagggtactaggagacacagactgaatttgcaaggggcatatttaggtacagc

SEQ ID NO: 13922 - DNA, 16279 bp, Homo sapiens
tggctaggagcgccgaccgcagggcctctacgggtgaggagggaccggggccggggcgcgagagcaggaccgtgtgtcctgggggctggggcgggcctgccctcaggtttatctaacaggtgtgtctggtgccccggccaggcccccgggggtgttgtgtggaggagctgggcgttaatcctcgccagctgggtgcacatggtgtggagcgcggttcccaggaagttgaacgcacgcgcgcctggagcagaggttaaggatgatggccagcggtccggccatacgctggtcttggcctggcagggctggaactgggactggggtcggaacttcgctccccagactttggcgtgggaaatgagacagttggtcgcgctctctgcagccatcggttttgaatgggcacgaacgtcccaggccccttctcttctcccattcccgggcgcatcccacggtggtcggagccattgaggcagctgctccgaagaccacctccgcaccgagtaggtcggcgctttccccagggtacagagggacattctttgtctctttttcctaggctcctacccctagaaataccgagtactgtactgtgatttctgttgcgggagctgatgtttatgtaagccaaactaatttaaaattttcatacaaaattgaacgggcgattataggattcgttttgttaggataatccctcatgaacgaatcctagaatggatcttaagaaattaatttaggcaggatttgctaaataggggagagagcgctagctgtatggtatgatgatgtaaagattggggtctgttgaggatggtaatcgagctcaagatgcgaaaacgaggattctagccccaagtcacttacttgctgtgttacctaaggggcaagtcttgggagttccaggtgctccagcttcctcatcggtagactgggaataacgcctagattgtaaaggtcaaactatcagaaaatacttttgaacattcatgcagttacacaatttaataaatatggccaggtgtgttaaaaatctttaacggaatagattcagaatggattcttgttatcgaaattgttataaaatgaatataaaggaatccgaagtccgcccctcccccattcacctgtacttagaaggttccccaggagctcttgagaaatacataggctggtttagatttggccttagattgtattttttaaaatttgtagatcgacttttaaaatcttcatctccggtgtctattacttgttgctctccgttggttgcttctagcagcagcctctctccccattcgtattccaacctgatacagaggctcagacgccaaatagttgaagttttgtttaaaaaatattcaattgagtgaaaaaatattcaactgatgtgatgactagtaaaaatgaatttggtgtatgctttccgcgatattgtggcagtttgggaatttttttttttttttttttttttgtccttctggattttctgaaatgtgacctacaggtaagtcttattcgttattcattcactaggcattattgggctagggttaggcttaaacgggtcttctaaacgcctgctaatttagcagttaatcagaaaaggttctgaggaatacttaaggaggattagtgtttaaagttcatctaaaaactttaaagaacctaatgatatgatgagattccgcttcacacaactgtgcaattttattcgcagaaatttcctagttttgcaatatctgggcacctgaagatgctaaaagattatttatataaaattacttatttaattatgttctaaacccccttggaaccaggtttcaagtcatatcttgcttcactttgcccagtaccttagttgggcaccagcagaattttacggtttgaggacagagtgagctaaagtgggccttcagtatggctctgttttgtagaatagctcataaaaaaatttttgatgttaatttctgattgcctggttaatagattcttatttcaatctgtaatgctttgtttaatgtattttgactagtctgattcccattttccaaatgtaggttctaagtgctgcttatgacttaatttttaacccttgtacaacagtaagatagggaatttatctactctagtgcatcttcagtgtaatggttaagagcagagtctgaagtcatactacctagcaggactggctacgtaatctgtggtaatccaaattaaaatgcagggttccttgttaaaaaattaagaacttcaaaacagtggcagcagggtatcaaacttaagtgcagggccctgtgtaacggcacaggtcaggggcttctgaagctggccctgttgcctcattttgaatcctcactctgttcttattggcactctaaccttgagcaagttactgtgcctgcttccttatctgtaaaattgggataataatgatacatcgttcattgtatttttaagagttaacatatagaaagttttcaataagtgttagccaatattatttatttttatgatcattcgtggaaaaggactgtctcatcaaagaaaagtacaagaaaatattagtatttcctggttaaaattcattatttaagggcttcataatcctagttgttttcctgtatacttcttccctctcatgaaaattattaaccctatttttcatgttttctagaccacatttttattgtaaacacagacaactttataggaaaaaggaatctagttaaatgtggttaaggttgatttaaattctcttttgagttttctttgaactttgtatttacaactatatgtttaatagcaagaccaaaatgtttaaatagtgtgctgcctcgaggaatttacatttttaatactgtacacatttcactttattaatacttagcctgtttatctacatacctgaaaaacaatgttgctacctaccattcagatgagattacacacaaaaacctcaagggtccaatttagacaaaacactaaaacacgtggactcaatttcatctattaaaaacttgttttggctgagcatgctggttcacacttgtaattccagaactttgggaggctgaggctggaggatcacttgaggtcaggagttcaagaccagcctttccaacatggcaaagccccatctctactaaaaatacaaaaattagccaggcgtggtggtatgagcctgtagtcacaactactctggaggctgatgtgggaagctgaggtaggaggatcacttgagcccaggagtttgaggctgcagtgagctatgattgcaccactgcactccagcctgggcaacagagtaaaaccctgtctcaaaacaataaaacaaaacaaaaaacctattttgaatggctattaaacttgttaaatttgaaatgactgcttgatcatcacaatttctatattttccttaatattgttagaactgggtatagtgtatgcagcataatttgaatcattttgtgtgtgtgtggctggggggacctctcagcagtctacattataaactacgttcttttctacccaagaatgctaacttttggtataacataaacgtaagagcctgtcattctttttgtagttcctgtaaccagcacagtgcctgattcatgaattaaaggtaaaaaaaaatgaacaagaatttataaactttaattttaaatttattgctaactagcatatatcttattaagtacttgcagtattccaggcactgctaagtgcatgactgcatacagtaatgcatttaattctcccagtaatttcatctccattttacaaatgaggaaactagattctaaaagcttaattaccgtagtacatatcacacagttgacatttgaacaccaggtatgaatccaaagctcatgctctttctatgcctaggtttaaatcctggctccgctaattttgtgaccttgggcaagttacttaacattttctcatctgttaaaatgtagataataaccactcctaacctgtaggatggttgaaataaatgaattagtaaagctctttcaacagtctggcacataagaagtgctgagcaagtgttaacttctgttgttacatcacatcacactaccttcccataactagtatattgcagcattgcttatatagttacataggattatacaggcagaaacttattatccatctttaaggaaaagttaagaatatttgccctaaagcatactgtgacttatgaaataaggaacaattgggggttaggttattgggcaaattgttctctcattaaaatatggtttctttaactggatatagaaataagttggggactgctttttttggatctctaatccaaaaatccaaaacactccaaaatttgaaactttattgagggccaacatgatgccacaagtggaaaattccacatctggtataatgtacaaaaacttttccatgcacaaaattatttaaaatattgtgtaaaatatttgtgctatctgtataagatgtatatgaaacacaaatgaattttgacttgggtcccatccccaagatatctcattatgtatatgcaaatatccccaaatctgaaaaaaaaaaaaaaaaaaaaaaaaaaaaaaaatccaaaacctgaaacatttctggtcccaagcattttggataaggaatactcaacttttaattgttgggaagcatctgtttcttttagcaattctgtgctgcacagaagccccctggccccagttttatgctttgtatgatttgtttttcatccttcctatcgttacttctctgttatttagtctcagttttaaaacattacaactagtgagaacctgctcatttctaaatgttcaaaaaagagggggaaatatcatgatcacttttcaatagcatgaaaaacaccagctatttttaagctgcttagatgcaactgagaaacactatacagtttaattttaatttaatttttttgagacggagtttcactcttgttgcccaggctggaacgcaatggtgtgatctcagctcactgcagcctccacctcctgggttcaagtgattctcctgcctcagcctcccaagtagctgggattacaggtggccaccaccacacctggctaattttgtatttgtagtagagacagggtttcgccatgttggtcaggccggtcttgacctcctgacctctggtgatctacctgcctctgcctctcaaagtgctgggattaaaggcacgagccaccatgcctggtccataccacagatttttagaaaatctgctgtgaaaacaaaatcctgcagtgtatatctagcatagccaaggtaaagtatttctgagaatgccaaaaaaaaaaattaatttgagcctgttcatcaattttcttctattcatggttcattgaaaaaaaaaaaaaaagctacatgtggctagacatggtggctcacacctgtgatacagcactttgggaggctgaggcaggcgaatcacccgaggtcaggaatttgagaccagcctggctgacatggcgaaactccgtctctactaaaaatacaaaaaaaactagctgggcgtggtggcaggtgcctgtaatcccagctactcagaaggctgaggcaggagaattgcttaaacctgggaggcggaggttgtggtgagccaagatcacatcattgcactccagcctgggcaataagagcgaaactccatctcaaaaaaaaaaaaaggctacatgcccagtaagttttttgagagggaatttcactcttacattgcccaggctggagtgcaatggcgcaatctcaactcaccacaacctctgcctcccaggttctgaggcgattctcctgcctcagcctcccgagtagctgggattacaggcatgcgccaccacgcccgactaattttgtatttttagtagagatgggggtttctccatgttggtcaggctggtctcgaactcccgacctcaggtgatctgcccacctcggcctcccaaagtgttggtattacaggtgtgagccaccgtgcacagctgaaagttttctttattggcaagtaagactaagagattacttttttaaaaaaaatttttttccccttgcaatttcctgttgaaacagatgccttcttggctcaataataaaatccaagaacataatgtaaaaaatttaagagcccatgaaaagtcagctattcatttagtagcaccaacccagaggaaaaacatgttttaaaagacctgataatagccgggcgcagtggctcacgcctgtaatcccagcactttgggaggccgaggcgggcagatcacctgaggtcgggagtttgagaccagcctggctaacacggcgaaatcccgtctctattaaaaatacaaaaaaattagccgggcgtggtgtcacgtgcctataatcccagatactcaggaggctgaaagaggagaatcacttgaacccagaaggcagaggttgcagtgagccgggatcacgcctctgcactccagcctgggcaacagagtgagactgtctgaaaaaaaaaaaaaaaaaaagacttgataataaatgggattttatagtttaaaacttactaatttagtcacttagccatttttttatctgatagtaggcatgatttttctatttatctgtagttgtggaatttaatgttagattcaggctgggttgcagtaaaatatctcgcatatgtgctaaagaatgcttctaattgcattaatttatattaactttctcaacaatcataattttccttctattaaataaagtgacttaatattcaaatttttattttagaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtaatgtacaaaatcctgtgtaaaattagagttagccttccatttttctctaaacattatgatgcagataattttttttaaatatttgacttttggactattttttgtataatacttagtttttaaagtgatggacactcaataccaatgagtgtgtgtcatggctaagaccaaatattactgtgaaatatttaaaatgacttaaatacaacatcactccttcctaattaagccaaaaagatttctcataaacaaaaattaaattatcatgtatgatgacacataaggagggatcttaagaagctggttggggaatgaaggtggaaataattttccttggataaattgaaagggtttttatacagttatttcttttttaacatctaaattctccaagttaacttccttaaactttggtaattaaaagtcaactttgtccttttcacaattatctctttgctagacagcctgaagggcctaattttggcctaattattgagtgtaggaaagttaagattttcaaaattccaggtgcactgttcacatcaatttccggtaacactaatgaaattcactagaaattacaattttaaagagtgtaatctcaacagtgttacttatactttaatttacgaatattgtatttagccatgttgcacctttaagtaaaaccaaatcacatatttgggaaaatctggcaccctttgcattgaacttaatgtaaaatataatacattgaagaatgtatgttctgggtctataaatactggatattaaggtcagcactatttaaaacatcttatgcaggcagaagcactggtaaaacctgttatttttgttatatgtagtgattatagaagaatagggttcactttattctaataattaaaagattatagaaagttctgaaaaaataattgcctgtaagcccacctgcttaatatattgcttattttcatactgtcttccttttgctattctcgtaatttgaaatctgtttttcaaaactaggtttttttaaggtattgggtcagctaacagagactggagttgtcagccctgaacaatttatgagtaagtactataacctctttttcctgaaataaagggaaacatgatttcatttttgtttagagctgttcagtgcccacttctgtttttgttcaaatagctggaaattattcaaagaacaaattagctgttttatacaaatgtttaatgtggctgagttgttctagaatccaaatgtaccagtaactttgtttttgcaaactatctgactactttattagataattattgtaccataggacctaggtgttagctctagaggtttttcgtttttttattgtagtatttcccttactgtggttatttacagaaatttcattaccaaatcaaaaaagcaagactatacgctttaaatttattttggggtttatttgtattgaagtttaaggttagcaggcatcttaagagttagtccacccgtcccctgcccctcttcttttagacataggagaaaataggaatttagagagatccaaagacttgcccaagatcacaggtagttattgctacggtgaggaataaaaccttaattctgtccagtgctctaccactgctttttcctgttataaaggaaatgaagtattattatcattactaaatatttagtaatatttaatagctgaggaattacaattcttcatttccttataatagggaattttgtattgaattctatttgaccctcctgagaatgaggaccatcattctgattctcattgtttattttcattcactgaatttctttttcccattttagatctctatctggaatgagaccatagaaattaacaatatgagagactattagcctcaatttttattcctgaatttttctttgcatgcacatgaattagatgagaaaccatgttatttcagcaatagtactgaaaatccatttgaggggaagtatctttgcacctatttgctatgtgacttggaaaagttacttggaaacagatatgtttttacttccttgcaaggtgctctcaaagcaaacaagagcaagtcatgttatcacaaaacactttccatcacaaagggaaaattaaaatatattttgtaaaaatattttgaaagcaaaagactaaaaattctagaattgagccatgtaaacatgctcttgttaaaatgtgcaaaggttatatttgaatatctattgagtataaaagttaaagagatctatttaaagtaaatgaagaaattgaagttttcattagtcatggaagtggcaacatcagccatttacttgtattttaagtgttgttcatctaaaatagctatattagtctttattttgctagcagatattttgaatgtgtaggttatattccaattgatactaattgctgatatttcaactacttggtaatattttctttagaaatggaaggtaaattactatggtaaaacagctttaaacatttagtaattaagtcagctaatcctaatatttttctggctccccataaaattgaatgtctactatgtaacactttgttatccaatttccacagaatcttttgagcatatgaagaaatctggggattattatgttacagttgtagaagatgtgactctaggacagattgttgctacggcaactctgattatagaacataaattcatccattcctgtgctaaggtatgtgctgcttataaataaaatggacagctgttttctagcacaactgactttgagtttccattagacaaatctgttttctcattgattttcagtgcctcttagaaatcccttttcccagtgtgttctgagagctttaagaaagaaaatgtataacagtatgaattgtatgctaaaattgttctgtaaggtggatcaatttggtataggcatagagaaaccaaacaacttagcagtaatgcacaaaatccctaatgttactcttttaaaaaaaacaactctgaatataccacgttagcataaatttgtttccacatggtaaagggttcagattattccgttctaattatgatacatctaatgcatgtagtgccctttcatccctcaataactcacataaaatagtaaataaaaaaagagggagagaaaaccttaattcaatgagaataaggtaggaacacttgggatgtgttctgtcacacttaggaatttcggtggggtttctgtactagacattaattttatttggatatctaaaataacttgctagtaagcaaggagtagaatgatggatatattcatgaaaaggttacattttggtgatgttgatcctgatatttgtttaaagacaatggggtgggaaggttggggacatagccaaaacaagtttaggtcacaacttgactcatactatttcctctaataagtaaaaacatctttaaattattaacttttaatagtagtactctcatactagtaggaaacaaacttttgggctaatcagatttgccccagcttctctgtcatatttaaaaacaaaggaaatgttcagctattacagaatattctatgatctctccttctcataagttgtagaaatacatactgaaacagccttcactgtataatattttttgcatttgatttctgttaagttcaagtttacaaaatatactacttattatcagtaaattcttaccaactcgttttagctaaaaacaaaagtaaatgcttactcctttaaacattgtaaatattttcagagaggaagagtagaagatgttgttgttagtgatgaatgcagaggaaagcagcttggcaaattgtaagtaggcagaaacaaggtaaccctggataaattttgttccaatttagtttcttaacaagatacttgtttgaagttctttttggcttcattaattctgaacttattctcactctaatagtttagactgaatttcatgaagaaataaagtattattatacatattttgccttaaagtttgaaaattggaagcatacttctttacagacagtaacatctttaaattactaactttttatagtaatgctctcgtcctagtaggagataaacttttgggctaatcggatttgcctcagcttctctgtcatatttaaaaacaaaggaaatgttcaactattacagaatattctgtgatctctcattctcataagttgtagaaatacatactgaaacagccttcactgtatatatctaaatcatttaaaataaatataaataagtggtattgatttattgccattttataagaacttgtagttcttatttattataatttttagtttttgagacagggtctgtttttgacagctctgtcacccaggctgaggtgcagtggctcaatctcagctcactgcagcctcagcctcctgggctcaagcaatcctcttcagccccccaattagctgggactacaggtacacgccacacctggctaatttttaaaaatttgtagagatggggcctcatcatgttgctcaggctggtctcaaacagtgctcctgccttggcctcccaaagtgctgggattacaggtgggagccactgtgcctggcccaagaacttgctttttaacactaactcttctgagttttaaggaattaacaaatattaaatacctgcttatgtaccagatgctattctaggtatttggaatacctcagtgaacaaaacagaccgatttcttgtgttctagtctatataatttatgttttttttttttttttttttttttttaagagatgggatctctttctgttgcccaggctggagtatacagtggtacgatcacagctcactgcagccttgaatttctggggctcaagtgagcctctcgcctcagcctcccaagtagctgggactacaggtgcatgccgctgcacccagctaattttttatagagatagggttttgctatgttgctttggctagtctcgaacttctggactcaagtgatccttggcctcctaaagtgctggaattacaggcatgagccactgcaaccagccaggcatacttcagtcaaggtcttttgttttttttaaaaataggagtttttagtctgttcaaacatgggcagacccttcaagtttgtatatcttttatagtttttatcctctaaggcacttagatccacactttaatactgggtttggattcattaagaaattttgtatagatgtagacttgctttgtttccacttcatattaattagaccaatcttgagttaatctgatacacaccttcacaaatattaaagtagctttaaaaatgattaaagagcaaagctattatgtactcattttatgtgggtatgtcgactgctccgaagttgtttaaatagatttaaataaagaatttttacaaaataattttggtcatttttttttttaaaggttgagtttttagtgttaacatgcatcttaaaattcgtttttctttttcaagacagagactcactctgttgcccaggctggagtgcagtggcacaatcactactcaccgcagccttgacctctctgggctcaggtgatcttcccccctcagcctctggagtagctgcgactttaggcatgtgccatcatgccctactaatttttatattttgtagagatggggttttgccgtgtttcccaggctggtgtcaaacccctgggctctagcgatcgcctgcctcggcttcccagagtgctaggattacaggtatgagtcactgcacctagccttaaatttcatttttaaagagggcttagggtgagttttgtatttgtcctgtttattagtgagctggagattactagataaaagtatatttgactctaagtaaaaatgctttggtgatttaaatgcttatcaacttacatgaatgcagtgggaaaagccataatctaaacctgtttctaaggaaacttaagttttataacattaattcatattgttactagaatcaatttttattaataaatgctatctcctcaccctaccccctttttaaatttcaggttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggggcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaggcttgcctgga

SEQ ID NO: 13923 - DNA, 1541 bp, Homo sapiens
ttttcaatattttggaggtataatggcacagcagttttaatacaaccaccaatcttcacaaaataattttaatactttgtgcctgggctagcagcatcttgcactgtgacattcctatacagacataagcattttatccaagtacaaatgttaaaagcagagtaacttaagcaattgtgtatacaaaggtatacagacactgtaggttatttttcttcttgaatcatttttgctgcatagtaaattgcaattacatgtcagtataatgttactgatctatagaatacactttgaactgtgaggtatggcagctccctatgagagagagctaacatgtaaacctgaatattttgagtgatttttgttttagctgccacagatgggaaagacaaaaaaaaaaaaaaaaattccagcattcaaagaccctagagacttacttttctaatcaattaaaaaaaaaggtctttcagtacttctcatctattttctagcattcccttatcggagcactgttgaacaaagaaagaaagaaaatactgaggtgaagctatgtttgttatgggattatggattaaatcagttatttaaaaaaaaaaaaatccgccaggtaactgctcatttactttacatcaagttgagatcttgatacatatatatatatatctcaactttataattcaagattgcagttaaatatttctaattcacttgaattaccatattaataagacaattagaaaccttatattttcttaatacagacatgcttaacattttctgacattacttctaaactcagatgaagcataaactctccccaaaactgctctaaaagttaagtggttgagttggtagcaaaagctatcatggtttaacatttccaccacagagtagatacaagtaaaggtcactgcagtttaaacatctaacaggtaagaaattaacatgaaccaactaactgaaattagaatactgccattccatgtttgaatattttcaatactcaagtttcatattttcaaaatggacagtaatacagtttccctatgttttgatacaatttcactataaattatgggcccagattacacttttaatgttggaattgggtggtcactcatacattatttaaatactctagaagataaatcatgatcagttaaatttatcatagttaactatcacaaaacatcagtggtaataaaagaatcacagaaatggaatcaaatagaataaagaataggaagagctaccagaactacttaaacattaggtggacagacatgcaagaaaaaacaaacctgtaatgttcttatatgaaataataaacttcatggtttgtctacattaatattgtactcagccaggcgcagtggctcacgcctgtaatcccagcactttgggaggccgaggtgggtggatcacttgaggtcaggagtttgagaccagcctggccaacatggtgaaaccccatctctactaaaactacaaaaattagccaggcatggtggcatgtgcctctaaccccagctacttgggag

SEQ ID NO: 13924 - DNA, 18733 bp, Homo sapiens; identical to SEQ ID NO: 10542

SEQ ID NO: 13925 - DNA, 649 bp, Homo sapiens
  misc_feature (49)..(49): n equals a,t,g, or c
atcttcacgcaagccttgaggcagagtctcatgttcccttctgattaancttgagtctcaggaaagtgaagtgacttgcccagggtccattcaggtagagttgagattcaaaccccacatgggctccaaagtctgcattgggtttgggggtgttttttggcatggcaccttcacctctctccctgcctgttttccccaaagtggaaaggaaggcctttcaaaccagagtgtctcattcccctctgacctccagaccagatggggcatgagccagccagctcagccaggctccctgttcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacactgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaactaga

SEQ ID NO: 13926 - DNA, 603 bp, Homo sapiens
  misc_feature (492)..(492): n equals a,t,g, or c
  misc_feature (506)..(506): n equals a,t,g, or c
  misc_feature (551)..(551): n equals a,t,g, or c
  misc_feature (556)..(556): n equals a,t,g, or c
  misc_feature (564)..(564): n equals a,t,g, or c
aacttgagtctcagggaagtgaagtgacttgcccagggtcactcagggagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgaacccttctcctgctgctctgggagggccagttccacactgagccagcctggtcccatggaaaatgatggcctgggctttctgaggccttatctgatgcctctgcagttcatgtcccccaccangcctcgaggctcanggtgggagagggccccgggctgccctgtcactcctctaacacttncctcncctgtccncaccatgcccttgtataaaattagagaagactaactaga

SEQ ID NO: 13927 - DNA, 12988 bp, Homo sapiens; identical to SEQ ID NO: 10543

SEQ ID NO: 13928 - DNA, 2982 bp, Homo sapiens
  misc_feature (313)..(313): n equals a,t,g, or c
acctccaccctcttgctgcccagaccctgaaggcctgacgggcctggcctcgcctccagggcatctcagtgccctcctggccctgttttctctactccctctggtccccagcactggctgttcgtttcctgtgagtgccttgcccttccccacctgcatctttgcactgttttccccaaaaagttttcccagacctctgcagacagccttctgagcctccgccctgggactgcccctctgggcagtgatgattcctacctacatttggagctttcatgtgctcttaatagcattttttttctctctccactcngcaggcctgtgggggaggggaacacatctggttcccctccttcccgtccccacatcctcagtgctcagctgagggtcttatcagcactcactgaatgagggagtggctcccgacattggcgacaactctttttccctctacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 13929 - DNA, 664 bp, Homo sapiens
tcatgttctcatgtctgcttctgcagtcagtcagatcacacgtcaggctctggaacactccaccatatactcaggagaaggaaagtcaaaaatgaaccttgcagaccccaaaagggtctcgggagtcgcctggccccagagtacattttgagaaccttggactccttgaatatcatcgcgtgtgtggcccaacacccccacccccccggaggacagctagggacactgaggctcacagggttacccgtgggtggacacccagccgggacacccagccaagagccctgcctgagcgcggcgctctgtcccttggaagtagtctccgaacacaccgcccttttgcaggaaaagggtcttctttcctgttgtaggctttgacgtgtacgctcggaagtggaaatgcccccagcccataccgaagagtttgtgtgaattcacccgagacctgtaggcagagtagaaactcccttacccccaacagctacctaccagcattgccgccgccaccccaggtttcatcacatcatgtaacgaaattttgatatttgcccgtcctggccccaaagctcagcatggcggcttgcctgtgggcgggtccctcttgctgcccctgtccagtctccatttcctccttaccctcttctgaccccccccacagcctgtt

SEQ ID NO: 13930 - DNA, 629 bp, Homo sapiens
gagcaactccattttgaataggggctgggtaaaataaggttgagacctactggctgcatttccagacggttagacattctgagtcacaggacgagataggaggtcggcacaagatacacgtcatagaggccctgctgatgaaacaggttgcagtaaagaagctggccaaaacaccaaaacccagatggccacaagagtgacctctggttgtcctcattgctacactcctaccagcgctgtgacagtttacaaatggcatgtcaatgtcaggaagtaaccctatatggtctaaaaaggggaagcatgaataacacacctctatttagcatataatcaagaaataggccaggcacggtggctcatgcctataactccagcactttgggaggctgaggcagatggatcacgaggtcaggagtttgagaccagcctggccaacatggtgaaaccctgtctctactaaaaatacaaaaattagccaggcatggtggtgcgtgcctgtaatctcagctactcgggaggctgaggcagcagaatcacttgaacccaggaggcggaggttgcagcgagccaagatcacgctactgcactccagcctgggcaacagagtgagactgtctcaaataaat

SEQ ID NO: 13931 - DNA, 4145 bp, Homo sapiens
tgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaaaaaaaaaaaaaaaaaaaaatggagctattttctgtctatataaatctacttatatgaataa

SEQ ID NO: 13932 - DNA, 4107 bp, Homo sapiens
tgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgactcttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtggaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcttctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgattgcttggcaaaaaaaaaaaaaaaaaaaaaaaaaaaaaaaa

SEQ ID NO: 13933 - DNA, 241 bp, Homo sapiens
gcggatcacctgaggtcgggcgttccagaccagcctgaccaacatggagaaaccccatctctactgaaaatacaaaattagccaggcgtggtggcacatgcctgtaatcccagctacttgggaggctgaggcaggagaattgcttgaacccgggaggcggaggttgtggtgagccgagatggtaccattgcattccagcctgggcaacaagagtgaaactctgtctcaaaaaaaaaaaaaa

SEQ ID NO: 13934 - DNA, 241 bp, Homo sapiens; identical to SEQ ID NO: 13933

SEQ ID NO: 13935 - DNA, 46843 bp, Homo sapiens
gctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcggtaagtgtctgctttttcccgccccagactacggagggggagcgaggggcagccccagcgctgctcaggaggcgagagactccgggggaagtcggcctccgtggccaccggccatcgttaccgagactgagtttctgtggctctttatctcgtcttccatgagaagttttattaaagatgcgctgtgccccttttgagttgtcttccgatttacctgagccaaataagatgtaggcagttgcaggcctgagtcttcgttttgctttcctgagcaagaatttagatgaagctacttccccgaaaatccttttacttgtacgagacttttatttttcctatgtgtttgtagtgcttaacacaatgtcctgcgtgtagtagacgttcaataaacgaatatggaatatcagttgaatgccaatgatgatttaagatagactgatagctctctctgtaccatttgacgctgctgaccatccatttcttgaaactttcccctgctgcctttcttcatgctatcctcacctgattctttcacatgcttaatttaacaaaatatatacttgttcttggctacaaggatacagaaatgaataacactaactctgccattgagaagctaacgcacataaatacacattatatcaagatgggtaatgagaaacactagttgcatataaagagctgtagaaagctgtgggagagctaaagtgctccttaggtgctttgtgaccctgagccagtttctattccaatctagcctcaatttcctcatctacttaataggcttgttttgaggaagaaaggagattaggtaagaggtttggtttggtttagtgcctagaatacagcaatcgtggtgccaaaggggagggaaatatttccctcaaatcgctttttctcagttttttgatatggccaactggtattttctaccttaatatagagtactatgcaaaagcatcttcaagtcttccttccagattactcctctgtccccatctatttggaaattctggacctgccacaggattacagtaagataaccataaatgtagctttttaaaaattgattttctcctatgtgccatggagaaagggaaagggaattagtaaaagctcctatctctttggttattttcagtcttggttaacgccgtccttttagttggccctcagtcattgctataacccaaatggtcttccacaggctctcctcgaggcttctcgcttgcttccatggcattgtccctatatgccaaccatgtccaaaccttattcttttcatttccaaaccttgttcttttccaaaccttatttgctctgtcgcccagactggagtaccgaggcaccatctcggctcactgcaacctccgcctcccaggttcaagcaattctcctgcctcagccttccgagtagctgggattacaggtgcctgccaccacgcccagctaatttttgtgtttttagtagagatggggttccaccatgttggccaggttggtcttgaactcctgacctgaagtgatccgcctgcttcggcctcccaaagtgctgggattacaggtgtgagccaccatgccctgcctaaaccttattctttagcctccatctcatgagttgatagttctgtactttcccctaaaacttgcaaactcattaggtccaaaaccaaatgcactgtcttcaccttccttttttttttttttttcactatgacatatgtcatgcatacgaaagtgtataaaagcagtgattgtcagtgcgtttttgagttttgacctctggttgaattttgtgatacaagtaggttaaatttttaaaaggattataagggctgtgagcaatggctcacgcctgtaatcccaatactttgggaggctgaggctggcagattgctttagctcaagagttcgagaccagcttgggtaacatggcgaaactccctgtctcaacaaaagagacaaaaattagccaggcttagtggcgccgcctgtagtcccagctagttggagggataatgaaatgaacatctatgtacacatccttcataaaaagtgaaacattaaaaataatacattaagtccctttgacctcttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagcccttaaccctagtttctttttctctagttcaaggccacatcttgtctcaactagccttatggagtatgggtagtgcatgtagtgtcctggctcttcagttttttccctccaatgtatttgttacactgtatctaaagatgtttctaaggtatagaacagatttctcattctgttgttttctttgggacatgttattaaatacttaatatagtgattatgaacccttgctgcacatcaatatagctagtgaaagttttcaaaacataaatgtcttgttttgcactccagattaagaatttagatgaagctactccccctaaaacttttttaccttactatctctggagagtctgattgagcatttaatttttactgataggcattatctaaatgtcattgaaataacgcattgcttgagcatatgcctcttatccctccttttccttttttatttttcacttttcctttttcttttcaatgttaaggccaactttccaaggaattcttttgattttcgttttaattttcttcttggtagcattttatgtaaagattctttttatggttgacctcatagccagaaagtatcgtaaagaaatgattcccagtgttcctgagttattacctcttgttgctaattgactttttttttggtataccttttttgctgcaaaagtacgaattggtgctgtgatattattttacataaaatgagttttaaaatttgaaaaacaattactttaatgaagagaaagttgcttgatacttcttgatataattgaatataatctttggtgctaagttaagacagaggtggtatgatgcataatttatcttttgaagggagtcttgtgttaaactgttatatttgattaggaattagaacttctctcatgctgggacaatttctggagtacatagtaggtgtttaatgaatgagtaaatgaatacaagtggcagctccatcccaacctctagtctgttgactagttgcactctaattctcacaaggaacgctttggaaaataattttcccttgacttaaaaaatagtgttctcagtcattactaaaaaattggaaattagaaaaagatataagaaaataaaaattgctggtcgtggtggctcacgcctgtaatcccagcactttgggaggctgaggcgggtggatcatgatgtcaggagttcaagaccagcctggccaagatagtgaaaacccatctctactacaaatataaaaaattagctgggtgtggtggcaggcacctgtaatcccagctacttgggaggccaaggcaggagaatcgcttgaactcggagggcagaggttgcagtgagccgagattgtgccactgcactccagtgggcacagagtgagactctgtctcaaaaaaaaaaaattgctagttattcatcatccagagataacaaatgttattttaacagtttattaaaatataattcttggctgggtgcggtggcttaagcctgtcccaacactttgggaggccaaggcaggcagatcacaaggtcaggagatccagagcatcctggctaacaaggtgaaaccccatctctactaaaaatacaaaaaattagccgagcatggtggcactccatgtagtcccagctacacgggaggctgaggcaggagaatcgcttgaatccagaaggcagatattgcagtgagccgagatcttgccactgcactctagcctgggtgacagagagacactacatctgaaaaaaaaaaaaaaaaatatatatatatatgtgtgtgtgtgtgtgtatatatatatacacacacacacacacataattcttagttcacctaaagtgtacaattgaaaggattatagtgtatttacaaagttacgcaactatcaccataatcaattttcgtacatttttattatcccatgaagaaaccccatacctattagcaatcattccctattttactccatctcctgagccctaagcaactattaatccactttctgtctctgtagatttatgtattctgaacaattcatgtggaaccataatatgtgatcttttgtgactgggttttttcacttatgtttcgaagattaatccatgttgtggcatatgttcagtacttcatttctttttattgcctagtgatatacctttgtattttattctacattttacttatccgttcataagttgaaggatatttgggttgtttctactttttggctattatgaataatgctgctctgaccattcatgtacaagtatttggatgatatcttattaagattttgatttacaattccctgatggctaatattttttaatacttgtttttagactgtgtttaacaaaatatggattatactacatatgcagttttgtagtctgccttttgcatttaagcctgtttttagcattagcaagcatattttacaaaagaattttcctaatttttgctcccctctttactccccgccaaaaccataaattcttgggaaaccttgcttaaattaatatacctagaaaatacaatccatattaatatataccagattattattggttgttaccatggtatgggagtgggtagaattaggggaattatattttctaccttaaatatttctgtaatgttttaacttttacagtgaagatacatcattttgtaatcacagaacataaaggtgaattatttccttggggaataagtagattcagcatgaaaaacagttcctaaatttgaaagtcataattaacattgtaaaattagtcattaaaatatatttcactaagctgggtgcggtggttcacgcctgtaatcctagcactttgggaggctgaggtgggtggatcacgaggtcaagaggtcgagaccatcctggccaacatggtgaaaccccgtctctactaaaaatacaaaaattaggtgggtgtggtggcatgcgcctgtagtcccagctactcagaaagctgaggcaggagaatctcttgaacccaggaggtggaggttgcagtgagctgagatcacaccactgcactccagcctggcgacagagtgagactccatctcaaaaaaaaaaaaaaaaaaatatatatatatatataacatatatatatataatgtatatattttactaaatacaatacctataggccattttgttaactaaatttacttttctgtggtcctagactgtgaacacatatgctgtgcagaattaagaaaaatatttagtattaaagtcagaaaagcaaatactggttattagcctttgactgctttatagaaaagtatacagttgtctcttgctatctgggggggattgattccaggaccaaaatcagaggatgctcaagtccctgatgtaaaatggtgtagtatttgcatatgacctatgcacatccttccatgtactttaaagcatctctagatcaatacctaatacaaaatgtaaatagttgttataccatatttatatccttaagaaaatacttgttatactgtattgtttagggaataatgacaagaaaagtctgtacatgttcactagagacacaattttttttctgaatgttttgatttgtagttggttgaatccatggttgtgaagccccagatacagaaggctgactgtactatgtagaagtaatttttctaagtatatttagttcttgaggctaatattgattcaaaaagtcattgacaaggacttagaagaaaggacttttggccaggtgcagtggctcatgcctgtctataatccgagcactttgggaggccacggtgggtggatcacctgaggtcaggagttcaagaccagcctgaccaacatggtgaaaccctgtctctactaaaaatacaaaaaattacctgggcgtggtggtgggcacctgtaatcctagctgctcgggaggttgcagtgagctgagattgccccattgcactccagcctgggcaacaagagcaaaactctgtctcaaaaaaaaaaagaacttttttgtagggattatgttgtaataggatttgacatagctaatcattagactctgtttatataatctcagatcaggcaaatctggcaggaatatttataattgtttatgtagagaaaggtgggtttttggacactgcagcttctgttgaataataatctggcagttgtaattgccactaaattttaaagattccaggagtggttcctgaatgatgggacagacacttctgtaagattgttcagaaaatttccagcttacttacactccatataatacagagagagatagttggtatcattaaaaaaagaaaggaagttaatagttaatatgctaggtttttgaagacagctttatatgtattgtctcatttaatcctcacaacagcccttcagggtaactaccttggtaatggtatcttcattttgcaagtgaggaaagtgaggctcagagagattaagtaacttgcccaaagtaacacagccagtatgtaacagagctaggatttgaatctaagtctgtcagactccaaaatctatgctctttccagtacttcacactgcagcaagtaagtgtgatacttggccctgtgattgccttacttagggcacccaaaacttcagcctgtttctattgcttactatccaaatcctagtcagaccccagttagaagaccctgtgactcgagccaggatcagtccttgtatgtactggtctgattgcagtgatagttatcatttctttctgaacgttgcaattactcctccacaaagaggaatatacatctttaaatatgattaaaatgtgatttcttctattatagcatagcagcaaaatttgtccttgcagtttccagcaggtgtattcaaccctataatttaaagcttcattcatactctagccaaaggactatgggaagtcattttgcttttttttggcagggaacggctgttctattccctatcctgcttatatcataaaattgttgtaagagtgaaatgagataatagatgttcaactgtaagaaagtactgtgtggtaatctcttacctttctaaaagccccatctaagtagagattcttcctttgtgaaattctagcatatacagatttatttctataaatcgttttagttaggcaagagaatcttgagagtgtacttgaattgtagattactccaacctgagatttaggcttagctattaacatacaaaaggtatttttcactttagtgtacatattagaacaaggtgaggttaatttttaagtatcttgttggaaatgcatggcagggaaattctgaagaagaattataagtaatgacaaataaatatatttaatgtacagtacaaattacccaagttattgtttttcttttgattcatcatattatcttcattgatttattttagtggcttttaaagatatttgcagtgcctttcatgactttagttctctggtctcgctttttccctaaggccttaaatacatcatttcattcattcataatgttcatttttattaaggatttactgtataaggctgaggatagataaagcagtgagctcacaggagaaagcaaaagaggcaaaaatccctgcccttgtgcaggttaaatttcttttcttttttttttttttttttttgttgttgttgttgttgttgagatggagttttgctctttcacccaggctggagtgcagtggcacgatctgggctcactgtaacctccacctcctgggttcaagcgattctcatgcctcagccttctgagtacctgggattacaggcatctgccaccgcgcctggctaatttttgtattttcagtagagatggggtttcaccatgttggccaggctggtctcgaactcctgacctcaggcaatccactcacctcggcctcccaaagtgctgggattacaggcatgagccaccacacctggccacagcttacatttcaatagtgagattataggtgacaaataatataaataagccatatgtcagttgataatagaacaataggaaaaaataaagggaagagggttgcagttttaaataagtgattagggaagacctcattgagaaatggcatctggacaaatctgaaggaaatgagggagggagttatgttgtcaagcagaggaagagcatgctggctagtaccgagacactgaggtggaaatgtgtagcagcaatagcaaggaggtcagtatgattaaaatcagtcatgcgtgtgtgttgggggtggggggtggagggggccttacagtccattctgaggactttacatctgtgtgcaatggaagtcattgagattttaagcaaaattctaacacggagttttcaggaacacatcatccttggacattgtagaggaaacactgtaagttaaaggtattattagatgttcttactcctctactgaaatgcaggattttattttgtttttgtgttttgtgttttaagacggagttttgctcttgtcatccaggctggagtgcagtggcaccatctcggctcactgcaacctccgcctcctggttcaagcaattctcctgcctcagtctccagagtagctgggattacaggcatctgccaccaagcctggctaatttttgtgtttttagtagagatggggtttcgccatgttgaccaggctggccttgaactcctgacttcaggtgatccacccgccttggcctcccaaagtgctgggattacaggcgtgagccactgggcccggacagattttgttattttatatattaaaactatatgtattcatgtattatataataaaatatattttttaaatttaaggcaaaaatgttttaaaatacacactgccagtaactacttgcagaaggaaaagtatattggaaaacctcacagaagtttttaaaatttttaaatttaaaacaaccagttaacatggaaagttagatttatatttaagaatttactaggcagccataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagacgaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagacacttcctaaagtttgcccccccaaaaagttaactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcaccatgttggctagactggtcttgaactcccaacctcaagcaatctgcctgccttggcctcccagagtgctgggattataggcgtaaaccaccatgcctggcttagtatagctttttaaaatgaaagatgatctgtttatgacatgacctctaaaaaagttaattgtggtgtcataaataggattctatcactcccagtaccaccatggtgaaggatataaactgaaacatctgaatcttatttcttaaatgaagaatattaatttaaggatcaataattattttgtataatgggtatggcataagaaataaaaagtcctggatcttttccatgaggtggttggctctcaggttaagtaacaatgtaattgtaaaaaaatcttatggtaagcaatttttttttcaatttcatcaagtattggtagtaagttttttttaagttctaaattaccaaattgtacttgagtgaaagtgtagtgtttaatttgtagctcagcctgggatatctgtttgccagtgataggtcctcaaatgcattttcccttcctgcctttttatgattcctctcacctctttactttctctatggtgaatgagtcagctatttcatcttcctgtttgtcttaaaattaattaattaatttatttatttattgagatggagtttcactcttgttgcccaggctggagtgcaatggcatgatctccagctcaccgcaatctccacctcccgggttcaagcgattcacctgtctcagcctcccaagtagctggcattacaggcatgtgccaccatacctggctaattttgtatttttagtagagacggggtttctccattttggtcagggtggtctcgaactcccaacctcaggtgatccgcctgcctcggcctcccaaagtgctgagattacaggcatgagccaccgcacctggcccaaaatttattttttttaatacggactttctctcttgttgcccaggctgagtgcagtggcgcgatctcagctcactgtaacctctgcctcccatcttcaagcgattctcctgcctcagccttctgagtagctggaattaaaggtgcctgccaccatgcccagctaattttttttttgtatttttagtagagatagggttttgccatgttggccaggctggtctcgaactcctgacctcagatgatccacccacctcggcctcccaaagtgctgggattacaggcgtgagccaccacgcctggtgctgtttctcttatttttaatctcctgtgtattctgtagaagggatctagtctggataatcttggttgactaaattagactacattagtttggaagggttaccaaaacagttgttttgaagagttaccttttctgctaatattgttcatattggaaaattgatattccccagaccgtgtttttagagccctttgaaatctctgtttccttctaactgtatacacctctgtcctaagcagaatgttttgtttcctgtcccctaaataatgctcagtgatccataagtacagtgcatatataaggcataagtatgtcccagacttacctctctctccatttctgcttatgctatttcatcttcctcaaattcccttttgtcttctccacttactcaaattctactcttatttcaggaccaaattcatactcagtctttccaataaagcctatactctctgccttagtctaaaattcttccttttctgttttctttttttgtggagacagagtctcactctgtcacccaggctggatggagtgcagtggtgtgatcatgacctccttggctcaagcaatcctcccctcaccctcccgagtagctgggactacaggcacatgccgccatgcctggctactttttttttttttttttttttttttttaagagttgaagtcctgcctgctatgttgcccaggctggtttccaactcctgagcccaagtgatcctccttccttggcctcccaaagtgctgggattacagacatgagccactgtacctggccttttttttcctttttttttttttcttgttccagagaagcagaatcaataaagggtgtgtgtgtgtgtgtgtgtgtgtgtgtgtgtgtgtgtgtgtgtgtgtgtgtgtagagagagagagggagaaatggatataaagatatgtatttattataaggaattggctcaggccgttatggagacttaagtttcaagatctgtaggatgagttggcaagctggagacccaggagagcccatggtgtagatccagtctgaatctgaaggcctgagaactcagagagccattgatgtagttttaatccaaaggcttgagacccacaaagaaccagtgtttcagtttgaaggcaagaaaagctgatgtccctgttagcagtcagacaggaggaattctctcttagtgtttattttagtgttcatttgtgtgccttgtcttaccagctagtaggtaagcatcttgagggcagggactacaaatcatatttgcttgtttatcatccataagcccttgcatccttacaagtagtaagtacatctaatatgtaatacttttataaaacagtaagattttagagctggaaagggtttttgactcttagttaactgaaacagaaagtctgttgcatgtgactattttttggaagaaccaggatcagaattttattttcggttcctcatcaagggctttttctaataattcttattaataataaatgataacttaaatcattatcctattttagagttttcctggaatcagaaacaggtttaaaatgggaagagaaccagccttggcaacataacatagtgagaccccgtctctacagataataaaaattagctgggcatggtggcatgcacctgtggtcccagctacttggggggctaaggcaggaggatttcctgcgcccaggaagttgaggctgcagtcagctgtgatcacaccactgcactccagcttgggtgacagagtgagaccctgtctcaaaaaaaaaaaaaaaagagtaaaataatatacctctttcctttgtggttagaagaataaaatgaaataatgtatgtggaatcacttagtatagcgcttcgatatagctgatagctgaacagttgctttttttgtactagaaaagttattaaaaccttttttcttttttttgcttaggagcaagaatcaaaatagtttgcagagtcctttaatgtgggaaattaggcagtattcctggagatttcacctttttctcctcttttaatttaaaaatgtgcatgatacataattcagttattcataagtattgtgccaaaaaaagaacatatttaatgtgagattatgtcattatttcctcaaagtatggtatttgacatgttaaatttgctgattcatatacaagattccaattaagtattcaaatataaggcatcataaccaagtagcagttttatctttatgacatgactgtatttaagcacaggttgaggctatggaaggtgatcttacagtatctaaacactagagtaatttgaacttaaatactctttagaactcttcagtcatgggaagtgaaattgattattctcacttaattttttttctgctgtagagttcttcgtaagtacatcttaaagctgtcaagatggttctagcagaccttggaagaaaaataacatcagcattacgctcgttgagcaatgccaccattatcaatgaagaggtatgtaaaatattgtatgaaatatatatgattgtatattgtcactagcattgggaagatggcttattcataatccctgtatttatatgtattttgatgtagacttaatacttgtagataaaagcctaaaagtggatacagtaagtagtgttttattgagaaattaactacaacttcaaatttacttcaactttctataaagaattttccaaaaaaaaatcgaaaaaaacctgaccttaacttacatgtaaaaataacatattttatcttttgaaagtggcttaaatctggaactgtacttttgttttctttattgatatagacctaaaatttcattactctgcttctttcttcttggctaggcctgtgcttatctgtccttttctttgtgacttttatttagcatttttataaaaggctagcatttccatcttgtctgttttgattcattttctttgaaatcttcagttttttggagattttgtaagccactccttagatgatattaaaatacttttcttcccggctatattattttaagatatttctttgttccatttgtcccccacagattgtatcttagtggtttattaattgaaaaagttgactgtggttcacaagtatactttatattttgtatcaacaatggaaaagtactgaatttggtgttagaagacattggttagtcccactgtagctatttagcagctgtacgatgtaaattggggcaactaaaccttagattccttagtgtataaaataggaaaaatagcatttaccatagaaaatggttttaagtttcaaataaactttctaacttggaggttagaaaacttacgtagaattcttacatggaatttgatctcaatactaagctaacggaattaaataattttgagaccatcttagagatcatttagttcagcctcttatttaacagaaccaaagtcagtttcatgtgattatttatttggaagaaccaggattagaacctttttttcctagttcctcatacagggctttttctaatactgcttattaaaaaataaatcataacttaaatcattgtttggtcttgtaattccaaatatataaaacgactttccaaacagttttccctgttgtgtagcccttatgttctttgtgtttatagtagaaaggaaaggaaaccaggggaggagttcttggtgggaggtagagtaacagctgttgcttaaattggcagcttctctgttcttgatactgtgctgctagctaattaacaaggagaaagccctctagtgaaagatcagttcgaattttagcagacccgtttaatgagggatagagaaaactggtaagcctctctctgtagggcatatgaagtgagttgaaggagagagaacattcaagaaatatttgagggcctatgtttttgcagacatttttgctggcaccagagatacagcggtgaacaaaatagactaaaattcctaacctcatagagtttacattctagtgtgtgagcactttatatacatgagtggctaaagcctcatcttttcttaagacttttaattttatgaccttttaactacagtgccttgcaattcaacaaacatatgatgataataagttattaatggagagtagcctcctttccacctgtattctgctgctctaataaaaatgacaagactgggtaacttccttctgtcacatttacttccataattgtccagtttttaagaaaagcaatattaagccgggtgtggtagctcacacctgtaatcccagcactctgggaggctgaggcgggcggatcacctgaggtcaggagtttgagaccagcctggccaacatagtgaaactccatctctactaacaatacaaaaaattagctgggcgtggtggcaggcgcctgtaatcccagctactagggaggctgagacaggagaatctcttgaatctgggaggcggaggttgcagtgagccgagatcacgccattgcactccagcctgggcaacaagagcgaaactctgaaactctgttccaaaaaaaaaaaagaaaagcaaatattgtaactatataccactacataatagtgacaggagctcttcaataaagtagaaaacatcaaaggcaacatctatttgtagtaactttttttggcttgaatattgtctttattattactttgtgtgtatgtgtgtgtgtgtgtgtgtgtgtgtgtgtgtgtgtgtgtggttttttttttttttttttgagacaaagtctcactctgtcacccaggctggagtgcagtggcactatcttggctcactgcagcctccgcctcccgagttcaagtgattctcctgcctcagcctcctgagtagctgggatcacaggcacgtgccaccatgcccagctcatttttgtatttttagtagagatgaggtttcgccatgttggccaggctgttcttgaactcctgacctcaagtggtctgcccacctcggcctcccaaagtgttgggattacaggcgtgagccaccatgccgggcctataattacttttatataggaataaaattgtggcaattaatacttgggtgtaaaactaaatggggtctcttattttgacaaaatgactaaacatttaataaaattatctctccaagaactaactgaaaaacccagtagtgtggtattactaagctgtggttatgtaagtgatcaacaattgtttttatggaactgaaatgaaacattgggtgctttaaatttcatttatttctttattttcaggtattgaatgctatgctaaaagaagtctgtaccgctttgttggaagcagatgttaatattaaactagtgaagcaactaagagaaaatgttaagtaagttaaatcaatcaggtaaaacacaggcacagtttagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggctcttcatagaaaagtactgccattttattctttttaggcttaagatgatcttaatcaaccttcattattggaggactgtattctcttttgttctccttttggtttctctgtttcatatttgaatgaagaattaatgtgtttggtctcagttatcatattcattgggagaggcactgagttggtaggacacacagagcaatacaggtagctcagttaactgcttgagtcttatctcttaccatgctttagacatctctccttgtattgttagactgagattagttgtgggactaccagcatttaagcatttagacatagaggaagtagccgggcgcagtagctcacgcctgtaatcccagcactttgggaggctgaggtgggtggatcacgaggtcaggagatcgagaccagcctggccaacatggtgaaaccctgtttctactaaaaatacaaaaaattagccgggcatggtggcacacgcctgtaatcccagctactcaggaggctgaggcaggagaattgcttgagcctgggagacagaggttgcagtgagccgagatcatgccactgcactccatcctggctgatagtgagactgtctcaaaaaaaaaaaaagaaaaaagaaagaaaagaaatagagaaagtagtcctgatttctgttgtaaagatatataaaatatataagctgcaagaaaagtaaataaaactagttctttgtggtaatattaggacaaatttatatttatactttcaagtgtaatccttgaaaaccaaagtcttgcatctaatacttcatgggaaaactctttatgatatagacttacgagtctgtagtaattacatgcatgttaattggaagactattaatatgaatgactgaatgttgtacattctttggagcagaagcttctttttcttagagtttcttaactgattttctcctccccaccccaatcaccaaccaccatcataaaggtctgctattgatcttgaagagatggcatctggtcttaacaaaagaaaaatgattcagcatgctgtatttaaagaacttgtgaaggtaaaagtatatgaagattatgctgtgattctatactcagtggataaaaaagcgttagcactacaaatatttcagaatttttaaatatgttttttatggaatattcatctgtattaaaatattaatgaaaggattattgagttttcttagggacctttttttttttttttttgagaaggagtttcactcttgttgcccaggctggagtgcaacctccgcctcccgggttcaagcaattctcctgcctcagcctcccgagtagctgggattacagacgtgcaccaccatgcccggctaattctgtatttttagtagagacggggtttctctatgtgggtcaggctggtcttgaactcctgacctcaggcgatccgcccgcttcggcctcccaaagtgctgggattataggtgtgaaccactgcacctggccaggacctatttttattgtagactttactgaatatacataattctgagtgcagatatgaaagctagtactattcctgcaaaaaatgccaaagccaagatgcgatgagtgaaatttcactacagatttgttgatggaagggcctaagtttttcctcgttcactatcatgttttgcctagtgatggtcctgcttttgtatggcaaagtcacatatagcaagtattcttttctacactgttcgttgtgtaaggaattccctttgcaaagaccatgtatcccaattcttgcctagattatgagcaattttgaattagtgaaagttttattttcaaatagtaaatatagccagttgccctgcctcaccttattgctgatcatgcaaattatggtgaaaatcttagagcttaaaaaatatatatgggctcagttgtagaaaaaaaaagaaaggagctgttaaaaaaattattttagtccaggcatggtggctcatgcctgtaatcacagtgctttgggaggcggaggtgggaggattgcttgaggccaggagtttgagaccaaccagggcaacatagtgagaaccagtctctataaaaaaaaaaaaaattgataaaaatagctggtgcaggccgggtgcagtggctcacatctgtaatcccagcactgtgggaggctgagatgggtaaccacctgaggtcaggcgttcgagaccagcctggccaacatggtgtaaccccatctctgctaaaaatacaaaaattagccgggcatggtggtgcacatctgtagttccagctactccggagggtgaggcaggagtattgcttgagcccaggagttcgggggtgcagtgagccgtgattgtgccactgcactcccgactgggggagagggtgagaccctgtctttaaaaaaaaacaaacaaaaaaaattttttagagcattagatgcccactagttctacaatcatttttcccccacattgtttgaatattttctttttttttttttgactctccctctgtcactcaggctgaagtgcaatggcatgatctctgctcactgcaacctctgcctgccaggttcaagcaattctcctgcctcagcctcccaagtagctgggattacaggtgtgtgccaccacgcccagctaatttttttttgtatttttagttgagatggggtttcaccatgttggccaggatggtctctatctcttgacctagtgatctgcctgccttagcctcccaaagtgctgggactacaaccatgagtcactgtgcctggcctccttttttttttttttttttttttttaagagacagtctgactctgttacccaggctggagtgtagtggtgcaatcatggctcactgtagcctcaacctcctgggctcaaacaatcctcctgcctcagtgccccccaagtagctggggctacaggtacatgccaccacgcccagctagtttttgcattttttgtagagacaaggttttgccatgttgccctagctggtcttgaactcctgacctcaagtgatccacctgccttggcctcccaaagtgttaggattacacatgtcagccactttgcctggccagaaatttttattgttaggggctcgtaactgtaggcaattctggagcatcaagtgctttattaagaagcatttattgagtacctactttatttcaggaagtatgccaaatgctgctgatagcagaaataaatgagactggttcttatactcagatgcttatggtctagaggaatggtgtacaaagcaaggtcaaaattattttcataatactaagacattatttgacttttgtactatgttgacatttgcactgaaaacaatggtaggtaaaactccctggtatgaatcaaggcagtggcaccagatgatactagtagtttctggactctctatttatttatttatttttgaagacagagtccctgtcattcaaactagagtgcagtggcgtgatcagagctcactgcggcctcaaattcctgggctcgagcgatcttctctcctcagcctccagagaagctaggactacaggcatgcaccaccatgttttttgtttgtttgttttttgtttttttggtttttttggttttttttttttttgagacagggtcttactctgttgcccaggctggagtgcagtggtgtgatcatggcttgctgcagcctcatcctccctgggctcaggtgatccctacacctgagcctcctagtagctgggactactactctttgagcccaggagtttgagaccagcctgagcaacatggtgaaaccccatcactacaaaaaatacaaaaattagctgggaacgatggcttacacctgtaaaccgagttactcgggagggtaaggtgggagaatcgcttgaatccgggaggtggaggttgcagtgagccgagaccacgccactgcactccagcctgggtgacagagcgagacctgtctcaaaataaataaataaataaataaataaagcttccaggcatggtggcgcatgcctgtaatcccagtactttggcaggccaaggcaggtggatcacctgaggtcaggagtttgagaccagcctgaccaacatggtgaaactccgtctctactaaataaaaaaaaaaaaaattagccatgtctagtggcacatgcctgtaatcccagctacttgggaggctgaggcaggagaatggcttgaacctgggaggcagaggttgcagtgagctgagatgacaccattgcacccagcctaggccacgagagcgaaactccatctaaaataaaaataaaaaggacttgtatctatcatctgtctctatcatgagtttgacagtatcccagtacttagttttctgatgagggtcagtattgatattaatgaataaagttttttgattatgtatagtgaaatatgtcaatgacgagagatctgcctaactcagtgaaccaatgttttgtgaatagctagtgcgtgatgttacaagatcatttaccagtataagattcatttaaaatgcaagatggaatcacagattttaatgtaacgagtataaaagtttatatggtttcagattctacattgcagctaacctttacaaactaccatgattataaagaagccctgagaccaagaagttgaaaactgctgttcttgatggtgggaggaagagaagacaaatttataaaattatttactaaaacatatatgttccaaataatgggtccatagagagctgggagtttttgccatgacatgtagaaaatggagatgaatgtggagcagcatcagtgtactgaaaggatctatgaggaagggaagtggatttatgtttaagacagattttgcctatttcaaaagtttgcctaagggtaggttgatgcctaggaaaggtataagaaaatgtattttcctctcttctctacctcatggctttccttgaaattcaagtataatatagatgatgtaatttttatggatggcttggcagactttctctcaaaggtttagactttgtggaccacgtgatttctattgcaactactcagctctgctgttgtggcacaaaagcagtaaatgggtcaggcacagtggcttatacctgtaatctcagcacttcaggaggccaaggctggaggattacttgaggccaagagttcaaaaccagtctgggcaacatagcaatactccatctctacaaacaaatactaaagttagccagacatcatggcatatgcctgtagttccagctactcaggaggctgagatggtaggatcgcttgagtccaagagttcgagactgcagtaagccatgattgattgtaccagtgcattctagcctgggtaacagagtaagaccctgtctcaaaaaaacaaaaaaagtggtaaatgaatgggcatgactgtattagattgaaatttttttcaatgtaataactagaaatgtaataactttacagcctgttgcccaggccggagtacagtggcctgatgatagctcattgcagtctcaaactcctgggctcaagcaatcttactgcctcagcctccttgattagctgggaccacaggtgcgtgccaccacacctggccaattctttaaattagtagagacaagatcttgctatgctgcccaagctggtctcaaactcctggtctcaatgaatcctcctcctttgtccccccgctgaaagggccgggattataggcatgagccaccacacccagcctccattgaaactttatttgcacatagtttaccaacccctgatctaggacattaactattatagatttattattttatcatacatttcaagctccaaacaactgacccccaagtgaattattttttaaatgtcccatgcttttttttgtttttgtttttgagatggagtctcgctctgtcacccaggctggagtgcggtggcgcgatctcggctcactgcaagctccgccacccgggttcatgccattctcctgcctcagccttcagagtagctgggactacaggcgcctgccaccacgcccggctaattttttgtatttttagcagagatggggtttcaccgtgttagccaggatggtctcaatctcctgaccttgtgatccacctgcctctgcctcccaaagtgctgggattacaggcatgagccaccgcgcccggccctaaatgtcccatgcttttttaatttggagactgtccctatatgaacctcagttttccactgactgattttaaagttgattattattttttactagccctctaaatgtagtaactttacagtaaatatttggcattggagaatttacagtttgacctggaaaatctttcacatataatctgtaattttgttaagtaaatatttgtcaaattgaatatggacattagcactctcgagtatggcatccactagccacatgtggttattgagcatttgtaatgtggctagtccaaactgagatgtgttttacatataaaatacacaccaggttttcagacttggtatgggaaaagaaatgtaaaatatctcattaattttttatatagattacatatgaaaatgataattttttagatgtattggggtagatactaaaattagtatcacctgtttttactttttaaatgtcagtactggaaattttaaaattcatgtgtagccttcatatacatttttgtattacatttctgtagtgctgatgtagattcctcctgtggcttaaatttggtttcacattttatactccagcttgttctaaaaaatgctgtgagatctttacctctgaattggtttggagtatagacttgattatgacttcttaaatttatgttcttaaattttactctgtctttacaaaggggaataattgtattataatagcttatggtagcttttacatgaaaatgtccttatttatataatttaaaagttgtggcagcacagtggctcacgcctgaaatcccagcactttgaggctgagacagaaggattgcttgaacccagaagttggaaaccagcctgggcaacatggcaagaccctgtctctacaaaaaaaaatttttttagttaactaggtgtggtggcgtgtgcctgtagtcccagttacttgggaggctgaagtgggagcatcatttgagcccaggaggttgaggctgcagtgagctctgattatgccactgcactccagcctgggtgacaagagtgtgaccctgtctcaaaaaaggaaaaaaaagttgtggggaaggggttttgaatttatatgtatgttaacctgattttatttttaatttatttttggtatttagcttgtagaccctggagttaaggcatggacacccactaaaggaaaacaaaatgtgattatgtttgttggattgcaagggagtggtaaaacaacaacatgttcaaaggtaaattgaacttaatttaaaaagaagtcatatggaagataggtttgtataaatcaagttttgtatttaatataaaaatgtaaagcctggctttataatgttgaaatatatattttattaattataattattagaatgcatttatatattataaataatgttattttatataaaatatatttacataaaatatatttatattataataaaatatatttacataaaatatattttattaaaatatatttatattataataaaatatatttacataaaatagattttattaaaatatatttacataaaatagattttattaaaatatatttacataaaatagattttattaaaatatatttacataaaatagattttattaaaatatatttacattaaaatatattaataacatattaagatataaagccaggctttataatattgttgctttataattttgtgttacttgatgtatgtttttaaatagttttttttaggataagaggagaggtcctcatagtttcttatgattttttttttgtaagaaggtagacatctgtaactatgctatttcttttattaaaaaaagaccattcctatcctttcaggaagtgagtgtgtgatttttggagaagagaacatggagtttactttatcctctatggctcaggactcctttttcaggttcccacccagcatactatagatcttcattttgtgtatccttatgccatatttttttagacagagtcttacttttattgcccaagcttgagtgcagtggcacgcaaacatagcttactgtagccttgaccgctttatgctaatttttaattcagtttaccactcctttctcccaaattgcatgtctcaacaatattacaagatttttccacaagcttcacgtatgttacagtttgagagggaaaaagagaaaaggatgatttttagatcgttttgttgttgtttgtttttaattaacattaatagtagttaacattttttgctatgatcatttgctacttgatcattttatatttgaatgctactgcatgacaattagaatataaaactttgtaggaaatttgccacattcaaaaatctttaataatattttcaggagaattataagcagttttattttactccttaggtaaataataaggaaaaacagaaaaaattatatgtatagtttgttatattttatgatattatatttttaaatcttttctcacccagctagcatattattaccagaggaaaggttggaagacctgtttaatatgtgcagacacattcagagcaggtaatgtcttgaaatttgaaaattgttttatataatttttattttcaagtttgaggattcatgaactctttatcttccaggggcttttgaccaactaaaacagaatgctaccaaagcaagaattccattttatggaaggtaggttactgttttttattttaacacttatatccctcttcttgtctgtcagcttttttttttttttttttttgagacggagtctccctctgtcacccaggctggggtgcaatggtgcgatcttggctcactgcaaccaccacctcctgggttcaagtgattctcctgtctcagcttcctgagtaactgggattacaggtgcccaccaccatgcccatctaaatttttgtatttttagtagagacagggttttaccatgttggccaggctggtctcgaactcctgacctcaggtgatccacctgcctcagcctcccaaagtgctggaattacaggcatgagccaccatgcctgaccatgccctgctaatttttttaaaaactttttgtaaagaccctgtcttataaaatatcctttgttgcccaggctggtcccaagctcctgggctcaaatgatcctcccacctcagcctcccgaagggctgggattacaggcttgagccactgtatgcagccacacacatgttcttattaagtgtatttctatctgagtttttggtggtggttcttaatttaggggaaaaactttttttgtaacattatgtgtctttatttgataatagtgatctgcatataaaaagttgccactaatcagaagagtgcaaattaaaatatctcatttcttgattttcaagttgacaaagattgtattggggattgtgaaaatgtagtgaaatagggatgagattaaacttttatggaagagatttgcctcataaaagcaaaaagccttaaatggtcataccatttgttccaaattcagcttataagaggtgtcataacatagtgtcaaagaagaaacatttatgtaccaattatattggcggtatttttaatatcaggaaattggaaacactgccatgcacagtggctcatatctgtaatcccagcacttcgggaggctgaggtgggaggattgcttgagcccagaagttggacaccagcctgggcaatatagcaagacctcatctctacaaaaaataaatttaaaaaattttcaggctgggcgcaccacgttgggaggctgaggcgggcggattatgaggtcaggagttcgagaccagcctggccaacacagtgaaaccctgtctctactaaaaatacagaaattagctgggcgtggtagtgggtgcctgtaatcctagctacttgggaggctgaggcagaagaatcgcttgaatctgggaggcgaaggttgcattgagccgagatcgtgccactacccttcagcctgggtgacagagctagacaccgtttaaaaaaaaaaatttttttaggccgggcacagtggctcacacctgtaatccccgtactttgggaggcttaggcgggtggatcacctgaggtcgggagttcaagaccagcctgaccaacatggagaaagcccgtttctactaaaaatacaaaataactggacgtggtggcgtgtgcctgtaatcccagctactcaggaggctgaggcaagagaattgcttgaacccgggaggcagaggttgcggtgagctgagatggcatcattgcactccaccatgggcaacaagagcaaaactgtgcctcaaaataaataaataaataaatttaaaaaagaaattggaggccaggcatgatggctcatgcatgtgatcccagcattttgggaggccaaggcgggcatatcatgaggtcagaagtttgagaccatcctgaccaacatggtgaaaccccgtctttactgaaaatacaaaaattagccaggcctggtggcaggcgcctgtaatcctagccacttgggaggctgaggcacgagaatcccttgaacccaggaggcagaagtggcagtgagccgagatcgcaccactgcactccagcctgggcaacagagtgaaactttgtctcaaaaataaataaataaatacataaaaattaaaaaaaaaattggaaaaacgtcaaatgtctaatagtagggcgttatttaataaatgatacagccatctgatagaatgctgtataacctcaaggttatgtgttacagaaatattttttcttttttcacccgtgttaatttttaaagagacatgccatggtcttgctctgttgcccaagttggagtgcagttgcatgatcataagctcactgcagtgtcgaactcatggactcaagtggtcctcctgcctcagtctcccaagtggctgggactataggcatattccactatgccagctagttttttttttttgtagagatggaatctcactatattgctcaggcttgttacaagaatatctactggttttataaaatgcttccaaatggatgttaaatggaaaaatgtgtgaaacactgtgagcatgagttcaattattaaagaagatataaaaaataaatttgaaggagacacaattcattcaaaaaagacatgcagtagaatcatactgggttttggaattggaaaattggataatgcttcatgcttttttagaagtagattctgtatttaatactttatagattttcctcttctaaattgaaattggggtcattttggctttttcaaaatagattataggtaaattaactttccgaattagtagtatttggaagttttgtcgttttgttaaatcatttgtccatgttatatagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatagtaagtagctttcaatgtaacactattattaggactttggttaatttaattataaaaccaggttgagtatatgaccaatataaattattctttgcctgtgaggcagatccccagtaatttatttttgttttgggcacctatatctatgtggtagggacttaatttcattatttttgttctccattaaatataaaattttcataagtatgaaaaagtaatttcctttctcagtcatcctattagtatgcataagaaaacatttaaaaattagtaattaggccgggtatggtggctcacatctataatcccagcactttgggaggccagggcggatggatcacaaggtcaggagttcaagatcagcctggccaacatggtgaaactccgtctctactaaaaatacaaaaattatctgggcatggtggtgggtgcctgtaatcccagctacctgggagctgaggcaggagaatagcttgaacccgggaggcagaggttgcagtgagccaagatcacgccattgcactccagcctgggcaacaagagcaaaactccatctccaaaaaaaaaaaaaaaaaaaattagtaattagcctttagtttctgttgaatttcctttttaaaaattcagttggaaatacttagatttttaaatactttaaaaaatattaattatcattttgtgtctctttaaaagtgtgatggaaacaatttgggggaggagaagcagtttatagatatctgcagcatatattattaggaacccacgtcttgacattggagtgttagcagtaattctttggtttgtggttaatgctaataagtttcttttcagttatgttgttattttgaccaagttgagcagatctaagggaagtagcctcaagtatattttatccgttttcagtatacactcttctactttgatttgcctttgtactttttttgcctagattgccattctttcaaatctttgcatataaccttttcctctttattcaggcctcagctcaaacattaggtccagagaggccttccctgactaccttactagaaaatgcctcccatacttcaaaactgatactctgtatcccattttcgttgttatacatctgaaatgtttatctatttattatatatgtcctctgactagaatgcaagtttcttaggacaaatattttctcatttacctttttgttctcatgacctagatggtacctgataatacatagtacttcaacaaatatttatggattgaataattatttatagtgtaaatgttgtagtttttttttttttttttttgagatggagtttcactcttgtcgcccaggctggagtgcagtggcatgatctcagctgactgcaacctctgcctcccgggttcaagtgattctcctgcctgagcctctcaagtagctgggattacaggcactcgccaccatgcctggctaatttttgtatgctaatttttgtatttttagtagagacggggttttcaccatgttggccaggctggtcttgaactatctcaggtgatccacctggctcggcctcccaaagtgctgggattacaggcatgagccactgcacctggctctaaatattgttttatagcttctaatgatgacatttgcttaggatcaataaaaatcttttctaaagtatcttttctatttaaactttctagcaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcgtaagtatcattgatactgttgtcctctgtcttgggattatatggggaaggatatgtgtttatagctttcatattgatcatttaaaatatgtttcaatagtgagcctaatatggtttataaagaaagtttaaatagaaacaattttggagcctgtctgatataggtctattataacttgtgaaatgaaacttgagttttgtacctttgtctaattagctttggaggcggattcacttcgaatttcagatctgctggaaatttgtggggttcttttgaggttattttatattttctttttttttccagagtcgctgccacaaaaagtccgattattttcattggtacaggggaacatatagatgactttgaacctttcaaaacacagccttttattagcaaacttcttggtatgtacagtggtggggatatagaaaaatctccaagaaatacgatgtatctttaggacaaaataggattttaattctgtcctcactaatttaagcacatcatttctttctgtgacttagtttccttacctgtaaaatagagataatggttatctgccctctgtggtgaaagtggtaaaatgaggtatctagtagaaagttctttggaaaagttttagagcacagtacaaaaacaagtggttttaataatagtggatgtaagggcagtaatactttggcaatgtctcaaggtggtatagttagagagcatggaatttggagttaaaccctgggctgcagtccttgctttgccacttgtttgttgccacttaactttttttttttttttttttgagacggagtttcgctcttgtcacccaggctggagtgcaatggcgggatctcagttcactgcaccttcagcctcccgggttcaagcgattttcctgccttagcctcccaggtagctgggattacaggcgtgcaccaccaggtccagctaatttttttttatttttagtagagacggggtttcaccatgttggccaggctagtctcaaactcctgacctcaggtgatccacccaccttggcctcccaaagtgctgggattacaggcatgagccaccgctcctggccatgccacttaactttcttagctttggttttctcatttgtgtagtgtagtaagaatacctaacctattataacctcacaaggttattatgtatgtgaatgtgttttgtataatgtgaagcagggtatagtattagttgttaatttttcttttttgtatcttataggtatgggcgacattgaaggactgatagataaagtcaacgagttgaagttggatgacaatgaagcacttatagagaagttgaaacatggtatatgagtgacaaaaaagcacttcatctcagatttcttccattgattttttttataaagttactattaagttatttgaaatgtaatatctgttagagtcagatcttccactgcttattattttagatgatttatatgcaaatcatttaaaatctcaggtacctgagcagttacagaattcagtgtttttattttctttattgtaataaaattaagattaaaataaggctttcactaggttccttgaagtttttctgttttttaagacagagtctcactctgttacccaggctggagtgcagtggtgcaatcttggctcaccgcaaactccacctcctgggttcaagtgattctcctgcctcagcctcctgagtagctgggattacgggcacgtaccaccaggcccggctaatttttgtatttttagtagagatgggttttgccatgttggccaggctggtcttgaactgctgacctcaggtgatccacccacctcagcctcccaaagtgctgagattacaggtgtgaaccactgtgcttggccggttccttgaagttaaacaggttaaaagtaagttagaacacaaggatgaaattaaatataccacattttctttaccccacatgaaagaccactcctgtagagaaggatattattctgattaggagctcaggttcttaaatataacatacctgtttttgtatctctgatctattttttagctttataactttttaaattacttagcctcaattttgtcatctataaaacgtacataatactaactacttcatatggttgtgaagattgcattcgctgatgcatgtacaatgtctggcacatcataaacactcaatgtatattattctcaaccattccagttgttctaaaaataatctttaattaccgtagcaactattctgcctctttgcttcttctcactcatcttaccagataattgtgcctttacttttctcttaaatgctggtgtttctcagggatcattcgaagttatctttctcaggagcttcagactcatgtatctgtgtttactagaccattcttggatgtttcatagacatctcaaattcagcatatccttattcccatcccaacctctcacctcgttgtcttatcaatgaatattaatatcatttatattgttgccagagtcagaaacttgggtgtcattattatttcttcctcactctgcccactcctttctccatcagttaactagtccaagtgtttccacctcctaaatatctccattccatccccttctctgtagctgcccttcaactatgctagttcatctctttcctagatcttcttattgtaagtctttcaacagatcttccatcttcctgtactcttcccctttgatgtattttttcatactacagcccagaataatctttcaaaactgcaaatctgatcccattactgcttttcttaaaattctttagtggctttctcttgcccttttaaagtttttaactgattttactgtctagctcacatcttccatgttgtgttttagcattgttgttcttagtattctgtgtgccagctatgctggacttcttttagtttctcaaatgtacattcctgtctctcacatctgggctgttgcctttgccagtccctctatctctcttcttacctctgccatcatctcctctggccaagatggctaactgctacttgcacttcagatttctccttaaatgtccttcttcagggacatttcacctgaaccctagactgagttggaaccttctgacagatgtttctatcacttcctacaattaatttttatattattcagcacaattatttgatgtctgtttttcctgcttgaaggtgaaggtagaggtcatagctgggttactcattttttatgttcacagtacctagcacagtgtctggcacatagtaggccttcagcaactattgaatgaatgaatttatcctttgttgcctgtctctttgccccttttttttcttttctttttttttttttttcttctttttttgagacagagtttcactcttgttgcccaggctggagtgcattggcacaatctcagctcagtgcaacctccgcctcccagtttgaagcagttctcctgcctcagcctccccattagctgggactacaggcatgcactgccacgcccggctaatttttgcatttttagtagaaatggggtttcaccatggtggccaggctgatctcgaactcctggcctcaggtgatctgcctgcctcggcctcccaaagtgctgagattacaggcatgagccaccttgcctggccgctccttcctttttctatcttggataatcctaccactgtttctgctaccactatgaagctgggtgtatattcctactctgtttcctttctgactcctgactctccttaagtctctacatttttgtttctatttctaatattctactcattctgagatctccaagggtctcctaatttccacatgtagtgacctttcttgttttccttggttcctaatatttaagtgttttctgccttttctgttttcagactctaagttctatgtctgtggatttcttatattattctagctttaattatcacttctgtataaatggccaaatatgtatttcaaccttaatcctctcttccactgtttaattctgcgtttctagttgactgctataacatttcttttaagatactgtactgccacttcacattcagaatgcctgaaccaaataccttttctctttttatctttaggacataaatagaaaatactttctcttttggcttgttccatccctgtttttaaaccttaggttagtatacatacaatgaaatgctcaaatcctaaggatacctttctttttttgacaaatgcacagtaacccacacccaatcaagaaacagaacatttccattactctaaaaggtttgcttgtgccctttcccggtaatacttcatattatagaagtcctgggctgtgcatggtggctcacactgtaatcctagtgctttaggaggccaaggtgggaggatcatttgaggtcaggagtttgagaccagcctgggcaatgtagtgagacccatatctcttagaaaaatccagtggcatgcatccatagtcataactactctggagactgaggcaggcggtcacttgagctcaagagtttgaggctaccagtgtgtgatgactgtaccacttcaatccagtctcagtgatagagcacaaccctcttaaaaaaataaagaaattctgagtatatcgtttttcttccaatctgttttctttgactaagcatattttgatattaattcatgtagttgtacttatctatagtttgttctttttattgctgaataatattttttccacagtgtatccattttcctgttcatagatacctaagctatttaagaaactccaaacaatcttctaaagtgtcttgctattctatattctcaccaatatatgggagttctttgtggtccacatccactttaacttttgatattgtcaacctttaaaattttactcatcctagtaggtgtagtttatgtgccttgttttcaggtttcttgtgtgtttgtatatgtgtcttctcagatagaatgtaagcttctctatgataggacctgtctttgtctatgtattctccccagcattcatcctgtcatcttgcacatggtaactgcttggtgaatatttattgatgtatattttataaatatgcttcaagatgaattcatgattaaggaataaattagttttgttgaatggaaatgtacatactttaatatatccgaattatttacattgtatttcaggtcagtttacgttgcgagacatgtatgagcaatttcaaaatatcatgaaaatgggccccttcagtcagatcttggttagttatccttaaaactttataccttcttttgttttcattaaattttctaaaatagatacacttgctttaattatttttacattcgggtaaaaatatatctaagacttagtgtcaatattaaacctaatagttaaatgtggacattttgaaccattaatcttaagctactattgactttatgtttaaatctgttgtaggggatgatccctggttttgggacagattttatgagcaaaggaaatgaacaggagtcaatggcaaggctaaagaaattaatgacaataatggatagtatgaatgatcaaggtaagatggcagattattttcctcaggcaaaaatgttctgagtatcagtaagatgagagtttcactgtattcttgtggacaagatggggagaaatttagcctgaaagattatttttaggtagatttgtaatagcttgaaagctcttactcaaagggttatgattattggattgccttcatcgttgagagaaatgtctagtataatacttctccaaatgagttacaaggaaagaacactagttcttcatgatgttcatagagttaacttaaaaggagaactctgagtcaaatgtggtggaatgctagtttttaaagagttaaatttggctgggtgaggtggctcacacctgtaatcctagcactttggcaggccaaggtgggaagattacttgaggccaggagtttaagaccaacctggccaaacgtagcaagaccctgcctctatgaaaaaaaattatttactgaaagtctcttcacggagctttaatattgctaacatacattgggaaactaagaaatggatagcttaagcaatgcttagaaaattctttctgtctgaaacataagaattcagttttctcagtatactgctctgttcccctgaccctataaaggcatgcctcagagatactgtgggtttggttctagaccactgcagtaaaggaaatatcatgcaataaagtcagtcatacagattgttttggttttccagtgtatataaaagttatgtttacaaatacatatactgtagtctattaagtgtgcaagagcattatatctaaaaaacaatgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggcgacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgctgctgctgctttatcaactaagtttatgtaatattctaacaatttgaacaatttttcatatctgtgctttatctactatctgatttattgttatttttttgtagtctctttttcctgagctccaggttttcatagtagcccaaataagactgtctttttcttttaaggttgttttttttcctcactgtctttaacactgcaaaaatgtttgcatgtagaattcataattgcagcatatctaaagtatccattctgtgccaggcactgtcctgagcactttaaatatattaattcattttatcatcataacaactcctatggcatattcagttattatctgcctttttcaaattaggaaactgggatacagggaagttgagtaatttgcccagtatagaacctttcctgacttccttccttctttgaattaacgccccttcctctatttgcttaactctgtcgtattacttgccacgatgtgctgctattagtttatcttctttcatttgatttgagctgttggaaggaatataatatatatgtttcataaatcttttataaggaagatgtggcttaaaagctgcatttatgaaatggatttggaggttttgatcgtgactttattttgagatattgtatctttgttagtattgcattgataattagacttcacctggatttcagttcacttctggacaatatacttagagggtatgtatagacaaattaaaagatgtaggaaatcaggatgataaatggggttctaaaccatgttagaagagtcagaggtggatatttgtcatccagcgaaaattcacaggagacatggtagctcttatgcatttgaaagctggccaggtgcggtggctctcaactgtaatcccagcattttgggaggctgaggtcggtggatcacttgaggtcaggagttcgagaccagcctgggcaacatggtgaaaccctgtctttactaaaagtacaaaaaaaattagctggctgtggtggcgtgtgcctatagttccagctactcaggagcctgaggtgggagaatcgcttgaaccctggaggtggtggttgcagtgagcgaagcttgcaccactgcactccagcctgagggacagagcaacactctgtctcaaaaaaaaaaaagattttgaaagccttattttttatgcgtagcaaggagacatatacatgaataggaatggaagtgccacgtaaatggatttcaatttaatatgtgtaaagaaaagatttttccctaagtataacagaatggcatagacagccttacattagatagcaggtcatctctcctggggatattaagaccaaggctagataaccatttatttgggggatattgcagagggaatgcagacataatggacattttgactaaagtccatcccattcctgagattgcatgcaactgaagctagaagaaatgcacctgatattctaagagtgatcaaacaactgcgggaattaattcactatatgctactgagagaattaaaatactagtagtagtaattacttgattataggaaataatttttctgttgattatggatagaacgtacctctttctgcttgcttatatagtctacattatgaatttatgattaatatttagggtagagctaaagtgagcatttgtgttcattttttaaatataccatatacctctgatgtttggagggcctggagagggtagacatatgaagtatggaaatgttggacatggggtctcgaaacattctattaatagtttacttaaactgtagggaaagtacatgtttgtttcattgtttttatagcttatgaatactataaatgttcttttgaatatattccgtattttctttttttttttgagatggagtctcgctctgtcgcccaggctggagtgcaatggcgcaatcttggctcactgcaacctctgcctcccaggttcaagcgattcttctgcctcagcctcccgagtagctgggactacaggcacatgccaccatgcccagctaatttttgtattattagtaaagacagggtttcaccatattggccaggctggtgtcgaactcctgacctcatgagctgcctgcctcggcctcacaaagtgttgtgattacaggcatgagccaccacgcctggcctccatgtttaatttttaaaactcaaaagcaaacatagcgaatgttaacatttgttaaatctgggtggtagtttgactatgtattatgtctgtttttctgtatgtaagatattttgtaatataaaaagaaaaatgagatagttatcactttaaaaacatctgctaagctctttgaagttatatattgcccatttgcacataactgctttgatggtgaatgataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtaagaaaaataagcttgttattagttaacagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcacgatggctcatgcctgtcatcctagcactttgggaggctgaggcgggcggatcacttgaggtcaggagttcaagaccagcctggccagcatggtgaaaccctgcctctacttaaaatacaaaaaatatccgggtgtcgtggggtgtacctgttatcccagctactcgggaggctgaggcaggagaatcacttgaacccaggaggcggagcttgcagtgagccgagattgtaccactgtactccagcctgggcagcagagtgagactccggtccccaaacacacacacacacacacacacacacacacacacacttcttctgagtaatactgtttaagttatgcatgtatctttgtctaatgtagtgccacttttttggacagtaaggctgattcattcacttctatatcagatcagtttttgtgcagttccatgagaccagggatttttgcctgttttgatcagaaacatagtagaagctaaaaaaattttgtagtaatataatttccattatatttctttatttatattattttgagacagagtctctctctgtcacccagactggagtgcagtggcacaatctcggctcactgcagcctctgcttcccaggctcaaacaattctcctgcctcagcctcccgagtaactgggattaaaggcatgcaccactaccgcctggctaatttttgtatttttagtagagacggggtttcactatgttggccaggctggtcttgaactcctgacctcaaatgatgtgcccgcctcggactcccaaagtgctgggattacaggcttgagccaccacgtccggcctcacttccattttaatggttgaatattttctcaatatgtgtttttacattattaagtttaacatttctttgtacatttactggtttgaatttactttgtgaatcacctcttcatgttccctgtccagttcttccatttttcccccttatatctttgtaatagctccttaaaatctttggtttatgtcttcaaatattttcccccagtttttcatttaccttttatttttatttatattttataatgaacagtagttgccctttttaatgtagccagcctatctttttttatttcttttatgctcataaacagcttccccttgtttattttttccttttttttttttctttacagaggtaatcaagttaaccttctccatgttgataccacagttgtcaccattttcttctttttttgagacagagtcttgctctgtcgcccaggctggagtgcactggcatgatctcagctcactgcaacctccgcctcctgggttcaagctattctcctgcctcagtctcccgagtagctgggatttcaagcacgtgccaccatgcccaactaatttttgtatttttagtagagactgggtttcaccatctttactggccaggctggtctcaaactcccaacctcaagtgattcgcccgccttagcttcctaaaatgctctgggattacaggcatgagccacaacacctggcttctacttgtttttgtttttattttgtgtttgactttttaatctcaattgaatttattttgctgtgtattatgtatcgtaaaaagataaggttttccaaagacttccaactgttccagtcctctttttgatttttttctataatgtaaacaactaattcagagtctgtgaaaatttgccttgaaacccattaaaatgaatttattgtttccaaaaatattaattagacaagctctgaatatgaacaataccattgaatagcttctaaaagaatgagtatttccagatgttttaaattaccttttgtctttgaagctttccttattttccttgcgatatcctattttctcttttgtgacaaaaaaattagacaaacatgttgaaaattggttataattcctaccatcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagtgggtatacacacagctatgtcacaccaaacttgaaatactttttagaagttttaaatgctgataaacaaactcttaggacaaatcactaatgagcatggaattcccatcttcttcagatttattcatcataaatggttttcacagattttatcataaaaacataatcttctctttcattcatagtttataattcacatgatttattcacattaaccagctgtgattggagaatcaggaggagctttgagtcccatattttataaatgcttctgagaagtaccatagttaatgcccctttcaaataaataattttggatggttgtggtggctcatacttgtaatcccagcactttgagaggccaaggcaggaggatcccatgagcccaggagggcaaggctgcagtgagccatgatcagagcactgcattccagcctgggcgacagagcaagagcctgtctcaaaaaaaaaaaaaaaaaaattgttgaagcagttctattcattgttgtagtgatgatctcttgctttcttttatgagtacagctgttgtctaaagggtgtttttatctattctgttgttgtttttttatttattgttgttgtttattttttgttgttttttgtttgtttgttttgttttgttttgagacagggtctcgctgtgtcacccaggctgggggctgaagtgcaatggcatgatcatggctcactgcagccttgacctcccaagctcaagcgatcctccaatctgaggcccccaagtagctgagactacagacgcatgctatcacactgagctaatgcttttttttgttttttttgtagagacagggtttccccatgttgcccaggctgatcttgaactcctgggctcaagtaatcagcctaccttcgccacctgaagtgctgggattacaaatgtgacccacctcacccaggctgcatctctttcattgactgccctttttactatggtgttttgacatagtgtagaaattccttgacaagtgaagttgcattatttgtctttgtattctctgaaggttttcattacttaaagaaaacttctggccaggcgctgtggcctacgcctgtaatcccagcactttgggaggccaaggcgggcagatcatgaggtcaagagatcgaaaccatcctggccaaaatggtgaaaccctgtctctactaaaaatacaaaaattagctgggtgtggtggctcatgcctgtaatcccagctactcgggaggctgagacaggagaatggtgtgaacccgggaggcgggggttgcagtgggctgagttcgtgccattgcactccagcctgggtgacagagctagactccatctcaaaaacaaaacaaaacaaaaaaaacttcttagatacatacacatcttcacgttctctcagactcatactttactttctactttcttttttttttttttttcttctgagacagagtcttgctctgtcgcccaggctggagtacagtggtgcgatcttgattcactgcaacctccgcctcccggattcaagcaattctgcctcagtctcctgagtagctgggactacaggcgtgtgccaccatgtctgactaatttattttgtattgttagtggagacggggtttcaccacgttggctaggctggtctcgaactcctgacctcaagtgatctgccagcctcggcctcccagagtgctaggattatagttgtgagccaccacagccagcccaacagactcatactttcatattcatctaccagccatccagtctctttgctaattaacccatgtctataaactcagctttttgtccagcattcccctgtatcactattaagccgttgttatagcttactattaaaaactgctggctgaccaggtacggtgtctcacacctgtaatcccagcactctgggaggctgaggtgagtgggtcacgaggtcaggtgtttgagaccagcctggccaagatggtgaaaccctgtctctactaaaaatacaaaaattagctgggtgtggtggcgggcacctgtaatcccagctacttgggaggctgaggcaggagaattacttgaacctgggaggtggaggttgcagtgagccgagatcacgccactgcactctagcctgggtgacagagcaagactccatctcaaaataaataaaaaataaaacactgggtacaattttgctaatagtggcttattcacagatataaataaagtattagcataaatcgtagccttaaaaaagccttttatatgtccttttatatagaattttacatggtcttcaaaaaatagtatgtaattgagaaaaagattagaagggaatatgtagaaatagaaagaattatgttagagtgataggattatgtaattttttcttagtattttctcagttcatcaaactttctattataccctgattatactgattatattacctcctacgctgactcaaaatctttttttttttcccctcaggtggcgacatgtctaagaatgtgagccagtcacagatggcaaaattgaaccaacaaatggccaaaatgatggatcctagggttcttcatcacatgggtaaataccaagttgttggcagttgctaatgcagtttaatttataagggttgagttttaatgataagccttttattgtaatattatgaaaatatgttcaaaaggtgtgtgatttcagggaaatggtcatctgaatcctaagttgaattcaattgtaatagggcttattagctgaggtcttattcactcctctgctgccatctgtgtgatgtttgagcaagctatttaatcatcttttgtttgttctggtgactttttcccttattttagaacctggatatttttacttatatgactgaggatttttaacctgagttctactttgactatataacctttacaaagttccttaaactttctgaacctcactttccccttcggtaaaatcacagatcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcgcaataactccgtaagataggctattcattctcttttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 13936 - DNA, 4136 bp, Homo sapiens
gggggagaggaacttgtttttgcctgcattgcccctcagacttggtttacctgtctgacactagtgctcattatttcctagcctaagctgtacaaagaaacatctaggctcccacctttgttttatgtttcttttttcctttttttttttgagatggcgtctcactctgttgcccaggctggagtgcagtggcgcaatcttggctcactgcaacctcagcctcctgggttcaagcaattctcttgcctcagcctcccgagtagctgggactacaggtgcacaccatcatgcctggctaattttttgtttttgtatttttagtagagacagggtttcaccatgttggccaggctggtctcaaactcctgacctcaggtgatctgcctgccttgcctcccaaagtgccaggattacaggcgtgagccactgcacacagccatgttgtctagttttaataaactcttatgaaactcaaaaccaaagccatactcaacatctagcgttgtcttttgttattccatcaaatggtataaaaattcaagaagagttataatttaaattaaaagtctaggcaaatgtcatgcaagacattatttaaatgacttaatgccagaggtttaaaaatttatttaaaaattataggagaggccaggcacagtggctcaggcctgtaatcccagcactttgggaggccgagatgggcgtatcacctgaggtcaggaattcgagaccagcctggccaacatggtgaaaccccacttctactaaaaatataaaaatcagccggacttggtggcatgtgccagtaatcccagctactcaggaggctgcactccagcctgggcaacagagcgagactccgtctcaaaaaaaaaaaaaaaaaaaaaacaaatttccccaggcaaaaggaaatctaattaggaaaatgaaaaatggttgtttagaagaatattttgtgctgtacttagaccacttcataaaaaggtatactaagagtttcagtttgggaagacaagagttctggagattaatagtgatatttacaaaacaacgtgaacatatttaatgccacttaactatacagtaaaaaatggtcaaaatggtctggccgtggtggctcacgcctgtaatcccagcactttgggaggctgaggtgggcagatcacgaggtcaggtgctcgagaccagcttggccaacatggtgaaaccccatctctactaaaaatacaaaaattagccaggtgtggtgcacgcctgtaatcccagctactcagaaggttgaggcaggagaatcgcttgaacctgggaggcagaggttgcagtgagccgagattgtgccattgcactctagcctgggcaaagagcaagactctgtctgaaggaaaaaaaaaaaggtcaaaatggtaaattttattttatacatattttaccacaataaagaaggtatactaatacactactttttttaaggattataaataaccatactcctttattttaagttcagtgatactctcacttcttaaaattttttttaatttttaatttttttttttttttgagacaggttctcactatgttgcccaggctggtctcacattcctgagcttaggcaattcacctacctcggcctcccaaagtgctacgattacaggagtgggccacatgcccggcctcacttcttaaaatattcgggttaataaacattcttcagaaactcaagttattttttaaattgtttaacaaattgcttgagcttcctcactacaggatctgctgaagagaggcacaagaagtacctttagatcaggtacgatggctcacacctgtaatcccagcactttgggaagccaaggtgggagtatctcttgaggccaggagtttgagaccagcctgggcaacatagtgagacactgtctctacaggaaatttaaaaaagctgggtgtggtggtttgcaccatagtccagctactcaggtactcaggatgctgaggtaggaggactgcttgagcccaggaggtcaaagctgcagtgggctataacagtgtcacggcacaccagcctccagcctgggtgacagagtgagaccctttctttaaaaacaacaaaaagtacctttaaaaaaagtaaaaatagggccgagcgcggtggctcacgcttgtaatcccagcacttcggaagaccgaggcgggcagatcacgaggtcaggagattgagaccatcctggctaacacggtgaaaccccgtctccactaaaaatacaaaaaaattagccaggcgtggtggcacgtgcctgtagtttcagctactcaggaggctgaggcaggagaatcgcttgaacccaggaagcggaggttgcggtgagccaagatcgtgccattgcactccagcctgggcgacagcaagactctgactcaaaaaaaaaaaaaaaaagtaaaaatatattctttagccagtgatattggctcttgtttacaaaattatccaaaacgttctttcaagtcttcctgattttgaaaaatagagtctcaactgatatctctaaaatttgaggctgggtacagtggctcatgcctgtaatttgaacactttaggaggttgaggtgggaggatcccttgaggccaagagtgtgaggctgtagtgagctatgatggtgccactgcactccagcctgggtgacaaagaccctatctcaaaaacaaacaaaacacaggaaaaaaaaaatcaaaatttagattgcaaatggctccacaaaacaaatcttgagggcaaagatgttttagtaattttacaattgccagctctaggcagtatgtgacatctttctaggcactcagtgcttttagaataaatgaccttgtgctgaggaatgtgaaaaaaaagatgtaaatcggtgctgttttattgacaaatgggatatgaagaatgaaatgtgcggccgagcacggtggctcacgcctgtaatcccagcactttggaaggcggaggcgggcagatcacgaggtcagcagatccagaccatcctggccaacacggtgaaaccccctctctactaaaaatacaaaaaattagccgggcgtggtggcgggcgcctgtagtcccagctactcgggaggctgaggcaggagaatggcgtgaacccgggaggcggagcttgcagtgagccaagattgcgccactgcactccagcctgggggacagagcgagactccgtctcaaaaacaaaaacaaaaacaaaaaagaaatgtgcaacatagggtttagatgaagtgacaggagactcagcatattatggaaattattatcttgattttgtgtatatagaaataaagctgtatccggctgggtgcggtggctcatgccagtaatccagcactttgggaggacgaggagggcagatcacgaggtcaggagttcaagaccagcctagccaacatagtaaaaccccgtctctactaaaaataccaaaattagctggacgcggtggttcgtgcctgtaatcccagctactccaggggcaggagaatcacttgaatccagaaggcagaggttgcaatgagctaagatcgtgctactgcactccagcctggcgacagactgagaatccgtctcaataaataaataaataaacaaagctgtgtatctggttttctatactttccaggtcaaatctcactagcagatgttcctgttatcttcagtttgacatcttatctaaaatgactcctaaaatgtgtaataatgttaattataatatctaaacctactgactctaacatcacaaagaattttaagaggtcgaggttaaaaatctaaaattgtaagtcatcagctaacaatgacatttcaagtcatgagcttggataaaaataaccatggaaatcaccattcagcaaaatacaggcatagtggccaggcgtggtggctcacgcctgcaatcccagcactctgggaggcccaggcaggaagatcacctgaggtcagcagtttgggaccagcctgggaaacatggtgaaactccgtctctactacaaatacaaaaatgagccgggcgtggtggcggacgcctgtaatcccagccactcaaaatcgctcgaatcagggaggtggaggttgcagtgagctggatggcgc

SEQ ID NO: 13937 - DNA, 123 bp, Homo sapiens
agggtcttgctttgttgcccaggctggagtgcagtggcacgatctcggctcactgcaacctctgcatcccaggttcaagtgattctcctgccttagcctcctgagtagctgggattacaggca

SEQ ID NO: 13938 - DNA, 1671 bp, Homo sapiens
ctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtcca

SEQ ID NO: 13939 - DNA, 421 bp, Homo sapiens
aaacatcaaggctccggagtcctccatctgggttgctgcagtgtttgaaaacataccaccctcttgactttgctaaattttcttcttggggtaaaagtgaactgacctattagaagctgttgtaatcaagttcaacttcttttggccacttcaagaaagtaaataggcttactattccccattgcaaaattgaagggtccaagaagcaatcttttccctatgaaattgtagtaacataactcatctctgccctcttaacatgggaggtgacaagtgtgttgagaactctcttcaagccagttgcagtgggtgtacctgtagttctagctactctggatgctgaggtgggaggatcacctgtccagcctgggcaacatagcaagacccccccaactcaaaaataaataattgagaaagcttt

SEQ ID NO: 13940 - DNA, 9361 bp, Homo sapiens
agaaccaaacacacatctggatcaccgagacataaaggcctgaagaagacccacttcatcaagaacatgaggcagtacgacaccaggaacagcaggtatgaagcggagccgggaaccgggccagggctgtggtctccataagcccacggggtcctgcccctgtcagccaagcaatcttccctccactcccaaagctcccgcccaccccacactccacacctctagaggtgggccctcctccccaccacactgcttgctccacatcagccgagcacccgcaggtccctggtgtcaccacagcgagatcaccctctctgggctcccaggtgaagggtcacacgtggacactagcctccagcaacagtgctgacgtgaaggaaaactggagacacagaaacgggtgtggctgtgagatgtgtggggaggagggctgggctttgttgggagcacggaggagaggctgaataaaccaaacacctggctgcccaaagctggcggagggccgcagctggcaccggctgcaccctgagaggctgtgtcggggaggccgcaggggctgttcctgtggccccgtattcccatcactgcatgtcctgaggtgtcctgaggtccagagtgctcccttccttctggagctccccctgccgggcaccctccttgtggtgactgtgggtctggatggacccttgctccccatcagtcctgtacagctcccagcagacgtgagtgccagccctggctcccgtcatccaagccagagagggggagaagttctcccactgttgtccccctggtgagaccctgggcccaggcagggcagagccagcgtccaagggaggagaaacagtggcttctgcctgtgctctctgggcccggggcccggctgctcgagcgccttggaagggagcctccaggccagcctctctgtggacctggatcaggccctttctggtggtgttgagccccgctccacccaggacctctgaggtctggctcgaggcagcccttggcctcgccatcctgtcccctctggctgcctctcatctctgaatgagccaagatcctgaggtgaggccgccagccctacccgcactgggtcaggaaggagccttcgggatgtcactgctgtgcctgcccacgtgcagcggcgtcccagggaggggaaccccggtagctcctgtagggaatccactctgagagcttgcgggggccaggcttagtgacggtggccacccggcctcctgggctcaagtccccttggacagcatgggcagtttcccagcacctgaatttaggcagaaggaattttccatggaaatgtctgtagctctggaagcagcagtaccttgagccccgctccccggccccgtctcccctgactccgtccccctgcaggatcgtgctcatctgtgccaagcggtccctgtgcgcggccttctcggtcctgccctatggggaaggcctgcggatcaggtgagtactcagcgcttgcctcgcatgcggtgtccatctaggcagaaggcaaggcctggtctcggccaggcccaggaggcatcagcgggcactgcgcccccaggtgcggctgcccccgggctcatgcgaggctcagcatgtcaacctccagcaaagctcctcaggaacccggggccgtttcgggtcctcactctccagaggagccggtttctgttcacgctgtcgatgtacaggtggctgggctgtcccacctcctgtggacagagccacttggtgctgtgaccatccaggcagtcgtatccgtgcgtaattcagggaaggaggaaacagctatggggtggggattatgtgtggccctggcttaaaaacagtggtggagaaacctgaccaggcgtgggcacatgtacctagtgggctagtgaaggtgggcgccaccccgggggctctaccagccagtgtctgtactggggaagcggggctcaaaaacccctccttccatgaaagcactcctgacgtgcgccttcctggtcacaccagtgccgcctttctttcccgaggggctgtgctgacattgttcccgagagcacctcgggccagcggacaggtgggctgggctgccagagcctgagttcagcgcagaccacagccccttgcctctcccatgtttgcagtgacctgagggtggacagccagaagcagaggcacccgtccggcggcgtctctgtgtcttccgagatggtctttgagctagaaggtgtggagctaggagcagacgggaaggtaagagcctcttcgctggtggacacccagcgccgtcagggccaggcaggcgggtgggagcagtcccacgtcagtgcccacgaggcacacgtgaagctgtgcttcactccacgtaaaacgcaagggtggagtggatgcgggcccgtgcagccctgagaacgtggccctggagcccgtcggactcccccgcctggccgtgcctgaggtctgcgccactgccccacagccaggtgctcctggacacccccctgctgcagggtggggctcgccaaccctctggcctctgtgctggtggtcagcagtcttcagaggcagggagaacgttacaggctacagaacccagataaagcacagtagtgttccggaatgttctagctatgtgaggagcagcgtctagctcagacgcagcctcaacggcttgatctgagttgttcccttcattttccatgcagggctcctggcatgtgcgtctgggcttcctgcagcgggagctcactttgccctctggtcccgggaggcagagctgaggccagatgcatttgcttttccaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactaggtagcccacgtgccttaaccacggcctggaacagggtgacccgcgtgccttaaccacggcccagggactgcagcagcatcagcaagcccctttcaatctgtagccctccgtgcagatggagcctggggaacagggtcaggagaggaacagctccacactgaatcgctatccctgggcttggcctgagccaggcagtggggaggagctgcatccacccacagatgactccagggagggcccctcctctcaggacatccttttcttgccctaagccctgggcccttcaggagagaaccatggcctagagcccctcccctgctcggccttgccccgccatggcgctggcctgccaggccttggggctagatgggtactgctcaagactcctggtgggtcaggggttgcctctcttacagggagtgacgtgggggacaccctggagtacaaccccaacctcctggatgacccgcagtggccctgcggcaagcacaaacgtgtcctcatctttgcgtcgtacatggtgagtgccctctcccagggcctgggtgcaggcagctgcacacctgtcctggctcggggcgtgtggggcaggctgtgggcaaagctgccccaggggcgtgacgtgcccccatcccggatcgcagcagcacagacagtggcggtgtgcagggcaggccagggagcagtgctggccactccagctggggtccacccttgcccttccgccctcggcacctggcaacctggctctccccacaccaagcaggcatgggctctggagttctctctcttgagccattttgttctcagagattcggggcctctcaagccacaccgtatgcatgtttgcaaacccaggacagtgagaaatccatcgtacccagcaggcaggacccatggactgtgcgaggggccggcccaaccctgcccactctctgttgcagaccacagtgatagaatacgtgaagccctcagacctcaaaaaggacatgaacgagaccttcagggagaagttcccccatgtcaaactgacgctgagcaaaatcaggaggtgaggacaccctctcagaccatctcatcgtcctgggaggccctgccagcctctcctctccagtttctggtagattctctccagcttgacaagtctagccgctgcccatccccaaccccctctcgccatccgaccaggcccccagcagcagctcccccacctccaccgcccgccaagccaggccccccgtggccccatcacactgcatccccccacacaccactgggtctctcacagccagaccctcgcagcagcccaggatctttttaaaacttgagtgggacaaggcctctgttgtgcccggcccctcccagtgtgtgctattttgtgagtagattccgtggcccttcccctggcccacaaagcgcccccatccaggcatgctgggtgctcgccaaggccgtccaggtgtgcctctgctctcacattgtgccacgctgatgacccatgaccggaggaaagcgagcagaaggcggcggaactgctgggctcacgtcgggctcctggccacggccctgtactgggggcctgccctgccggcctctgccccagtgttccagagggcagctcactcaataccctggcacctcccttcaaggctcttcctaaaaccacccctcatcagagaccactgccccccaccgagagcagagcctgtcctctgtggctccacccaccaggcacaggtgggagctgccatgggtgcccacccacgggacgggggaagccaaaacccagcctgccggtccctgcccatgcgccctgccctgggcgttatacatggtacggcggagggtaccatcccctgaaggatgcggtggtgtttcttgcggcccaaagctacatcgctccagcctcggttggtggtggcagggggctgcctcctcagccccagccagagcccccagggacatggcttctgtcttaacccacagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgatgtgagtgcccggctcggcaggcactgcaggcagggtcatgacatcgagccagggccactgctgggatggggctggccgggtgggaaatgtggaagagggaaggctcccgtgtaacccttctctcttctcccctgcagaagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatcagacctcagaatgtttgagttattttgtcttagatatctgtttttaaatggataatgtatttgtcctttaaacctcagttttgcaatatgtttcacagcttgtctcctttcaactaactgggtaccctaccccacccgtcacccactgacagcaaaacctcaaccctgggcctacagacacagaatgaacctgcacaggtaggttttcattatttatttatgacaaatattccacatctgtgattctctccagtcaaaagttcctagaaccaggggaaaaggacaacgttaagaccacgcctctggagcagtcctagtccactcactctgcccaaatgtgagcccccaaccttactttgagacgatgccatcggccttggccaatcggagaatggaatcatctgactcacccttaagaaaaaaaaaaaagcacactaagaatatttccactccggctgcctgagatggcagaaggtcagctgtgccaccagcccacgtctctcccccgctgagcgaatggagacaggcgcagaaggggagccacctctcccggggcagcctgcagcctgactatggtggagcggggtcgggggggcacctcctagtgagaggcagagtctgctgcctgagtgtcttctcagagcacccctcttccaccctcaagaagcggcaggcggccagcccagtccagctggctcaaactactctgccagcagatctactcaggcaccatcacacactccaatgcgcacggtaaagtccacgatgtcccgaagtgatgagcaaagcccagggaaacactcaccatcctacgaatggccccgcagatagcataagttttaaactggccattaaacctgcctgtgaccttgtcaacctagaaagagaagaagggtcacaaaccactcccccaggtttgggaaacaccaatcctcaaagccagcctctgcctgtaccttcaccccaggggctcctccacaatgggacagcctgcctttcccgcacatatatcacaaccttcccgcctcccgggctcccagctcacctcggccacgttcatctggatggatgcgtggtccttggcaccgatgatgcgattgctagcggagctgtggagaaagggcgcagtgagcagaggggacttgggcggtaagaatgaaagaggggacgagggaggttgggggtatatgaatggaaaagagtaacgtcgggggcaggacaagttagggacgtgacgaggtaaggacgggaggggtgtgggggaacaagggcaggcgaggggacgtggtggttaggtaaggacggaagagaggcatgtggggggcgcttaccatttccgcggcacgtacaggtccacgaactcgccggcgtcgttctgcatttcgaggctgggctgcgcctggggagtcaccgcgcggcgccgtgagtacggccggaaccgtgccccggctcccggcgcaaaccggcccctagggtcacggccccagccgcacccagcaccccgcaccccgtcccccgcgtccaagcccccactcccgccccagccccagccctgagcccgaagcccgcgccgcgcgccacacctgctgccaccacaccgcgcgcgagagagaaaggaagcagctagtcacccggcagagatatcggcgggcaaggaggggcctcggcgag

SEQ ID NO: 13941 - DNA, 683 bp, Homo sapiens
cgcacttccgcttccggcaaggaggttctcggaccccagcctgctggccctggggcgcggggcgtcgtgggggtcgttgtcgttgagggtcgttgccgtgtgtggcgtcttagcctggcccctgggttgtgccccacggacgcagtcgacccctctgagcgcctcgggagccccgaatagcagctgggagaaggggcgaggactgagcctcgctgcccgctgccggccgggctagagatacgggcgtgccccccattgtgcgcctcccgccctccggtcccctcaccctgcggccacctggggcgtggggcggtgctcctgcccgtgcacgtagccgctgcgagcggaggcctgctcacctggtgcctgctactcactcccccgggccggtgggcgaaggacacccgcaggaactcggcagaggagaaattcagacggctcccgagggtaggaaaagaccccggcccaccgtggaatctgaaacacccgaccactctgccatcccatgtttcaccagtcagacccccagggcagggcaggggaagcagaatgcaaactggggcaccgtttccctgaagcgtgttggccgcgtttgtcgtagtgctagaggtgcatacccttggaccccgaaaacccattcctgggaatttgctccaaggaagtaaagatgttacaaagatgga

SEQ ID NO: 13942 - DNA, 131 bp, Homo sapiens
gtggtggcgggcgcctgtagtcccagctactcgggaggctgaggcaggagaattgcttgaactcaggaggcggaggttgcagtgagcagagatcgcgccactgcactccagcctggcgacagagtgagact

SEQ ID NO: 13943 - DNA, 184 bp, Homo sapiens; identical to SEQ ID NO: 7572

SEQ ID NO: 13944 - DNA, 143 bp, Homo sapiens; identical to SEQ ID NO: 7597

SEQ ID NO: 13945 - DNA, 1405 bp, Homo sapiens
cacccctcgagtccactgttatttccttcactttcaataggctgtcattaaattctccttccccattatcagtgccactgcttcttctcttccatgttcacagtcttacttttagagctgtttagtcatcctacctatgctggtttctccatagcctttgaattctgtgtttgatacttttgaacagaacatctaaaagctccctttctgtattccaacactcatagggtgattctcattaagaaaacaaaaccaaaaattgagctcagactaaaggaattcttttttgactaaatagtgattaagttatgatattcctgttggcctaagaacaatgcctatgatttagttgtgttatgtatatttgtacttataaccaaacaatcgattgggtacaagtagccttagggcaatacttccttaaaaacatgtttctgataaactaaagctttagcattaaccagaagtcataatttaatagtattgtaaaaatacctcatttattttaaatcctgtgttgggtagaggattacagttgtcatttcaaatacatgaatctcttgtcaaaagagtactttgacagtttcatggtaagaccccttcatatactacctcaaggagtgagatttttattgtgcatgttgtttggatgtatggggttggagaggtaggttgagcctaaaatttcctaattactttactcttttacgtgtttcttattgcaaaggcaagaaattgttttcaagtttgtcattactaataacaaagagatctttttgttttttggcagtggtgaggatgagattgatggagttgctgctttagcttattggaggtgtggatcattttattttttgtgtttgaccggtcaagtgacttagtgagaagggggaagtagtagaacaaggagttccatctgtaactgtgaacagtcaattgtgataactcactacctttagaccagtcaataattattttaaagcctgggattatacaatatttgtttaactatggtatcaatttgtaacttaaattcatctcaattctttgtcctaagcagctctcagtttcattttttttgtttgctgtagaagaaaatattaagccaggctgggcacggtggctcacgcctgtaatcccagcactttgggaggccgaggcaggcggatcacgaggtcaagagattgagaccatcctggccaacatggtgaaaaccggtctctactaaaatacaaaaattagttgggtgtggtggcgcacgcctgtagtcccagctactcgggaggctgaggcaggagagtggcgtgaacctgggaggcggaggttgcagtgagccgagatggcgccactgcactccagcctggcgacagagtgagactctgtctaaaaaaaaaaaaaaaggaaa

SEQ ID NO: 13946 - DNA, 153 bp, Homo sapiens; identical to SEQ ID NO: 6795

SEQ ID NO: 13947 - DNA, 1406 bp, Homo sapiens
cacccctcgagtccactgttatttccttcactttcaataggctgtcattaaattctccttccccattatcagtgccactgcttcttctcttccatgttcacagtcttacttttagagctgtttagtcatcctacctatgctggtttctccatagcctttgaattctgtgtttgatacttttgaacagaacatctaaaagctccctttctgtattccaacactcatagggtgattctcattaagaaaacaaaaccaaaaattgagctcagactaaaggaattcttttttgactaaatagtgattaagttatgatattcctgttggcctaagaacaatgcctatgatttagttgtgttatgtatatttgtacttataaccaaacaatcgattgggtacaagtagccttagggcaatacttccttaaaaacatgtttctgataaactaaagctttagcattaaccagaagtcataatttaatagtattgtaaaaatacctcatttattttaaatcctgtgttgggtagaggattacagttgtcatttcaaatacatgaatctcttgtcaaaagagtactttgacagtttcatggtaagaccccttcatatactacctcaaggagtgagatttttattgtgcatgttgtttggatgtatggggttggagaggtaggttgagcctaaaatttcctaattactttactcttttacgtgtttcttattgcaaaggcaagaaattgttttcaagtttgtcattactaataacaaagagatctttttgttttttggcagtggtgaggatgagattgatggagttgctgctttagcttattggaggtgtggatcattttattttttgtgtttgaccggtcaagtgacttagtgagaagggggaagtagtagaacaaggagttccatctgtaactgtgaacagtcaattgtgataactcactacctttagaccagtcaataattattttaaagcctgggattatacaatatttgtttaactatggtatcaatttgtaacttaaattcatctcaattctttgtcctaagcagctctcagtttcattttttttgtttgctgtagaagaaaatattaagccaggctgggcacggctggctcacgcctgtaatcccagcactttgggaggccgaggcaggcggatcacgaggtcaagagattgagaccatcctggccaacatggtgaaaaccggtctctactaaaatacaaaaattagttgggtgtggtggcgcacgcctgtagtcccagctactcgggaggctgaggcaggagagtggcgtgaacctgggaggcggaggttgcagtgagccgagatggcgccactgcactccagcctggcgacagagtgagactctgtctaaaaaaaaaaaaaaaggaaa

SEQ ID NO: 13948 - DNA, 193 bp, Homo sapiens; identical to SEQ ID NO: 7690

SEQ ID NO: 13949 - DNA, 153 bp, Homo sapiens; identical to SEQ ID NO: 7724

SEQ ID NO: 13950 - DNA, 150 bp, Homo sapiens; identical to SEQ ID NO: 7399

SEQ ID NO: 13951 - DNA, 142 bp, Homo sapiens; identical to SEQ ID NO: 7400

SEQ ID NO: 13952 - DNA, 268 bp, Homo sapiens; identical to SEQ ID NO: 7767

SEQ ID NO: 13953 - DNA, 1548 bp, Homo sapiens; identical to SEQ ID NO: 7779

SEQ ID NO: 13954 - DNA, 4704 bp, Homo sapiens; identical to SEQ ID NO: 7404

SEQ ID NO: 13955 - DNA, 578 bp, Homo sapiens
caggaactcaaatgcttccacatctccctctctctggttctcttttatgcctctcatgttccgtccgttcattctcttgctctacagattggcttcctccatctgatagtggaacatggttgtcaaaactcacaaatttcacatcttgcaacattcaccatcagtgaggtgtttacttactttgagtttgaaaaattgagggaaaggctctgagtggccttgcatgggttagatgcccatctctggaccaatcagctatggccaggggtacaatctttaagaatataggctgggcacggtggctcatgcctacaatcccaacactttgggaggctgaggtgggaggatcgcttgagttcaggagttcgagaccagcctggccaacataggaaaaccccgactctactaaaaacacacacacaaatgagctgggcatggtggtgcatgcctgtaggaggctgaggcaggagagtcacttgaacctgggaggcagaagttgtattgagctgagattgcaccactgtactccagcctggataacagagtgaaactccatctcaaaaagaaaaaaaatatat

SEQ ID NO: 13956 - DNA, 144 bp, Homo sapiens
tttttgagacagagtttcgctcttgttgcccaggctggagtgcaaccgcatgatcttggctcactgcaacctccacctcccgggttcaagtgattctcctgcctcagcctcctgagtagctgggattacaggcacccgccacca

SEQ ID NO: 13957 - DNA, 719 bp, Homo sapiens
ctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaaggtgcctgaggcggggcgggatgtggtgtggaagctggggacctccctcctgcccactcattccctctctccaccccccagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatgtgagcctctgcctggcctgccccccaccattcccttcagggccgcccccaccctctgagacctcctgctccccacagacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaac

SEQ ID NO: 13958 - DNA, 340 bp, Homo sapiens
aacatggccaactctttcaccttcacccgctccctcagccgctacggtaggtgtcctcagtgtggtggccatgtgcccttcgagggaacccccacttccaagtgccatcgattctgtagagtgtagacggagggtcggccagcgagggcagatgggtccccacatgctgctgagctcccgggagagtggggcaggggccaggtggtggcctaagggtcacatgcattctctgctccagagagcttgctccgcacggccagcagccctgatagcctccgctcacgggcacccatgattacgcctgaccaggagacaggcaccaaattgtggcgacctggtg

SEQ ID NO: 13959 - DNA, 4094 bp, Homo sapiens
tgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgggcagaggggctaaaggtgggcagagcggctgtccgccccggggattgtgggcctttctggctggcaggtgctcacagcctctggactcgtaggtgtgggacgccattgaaggggtgctgtgctgcagcagcgaggaggtctcctcaggcattaccgctctggtgttcttggacaaaaggtgagcgtggcctgcctcagccccagatgtccccagcctttgttggctaggccatactctcttgagtcttgagttctggttctcttcaactgctgtactgtatgattcgattgaccttcttggtgcccagctccacacctgtgagcagagggcagtccacttggatgggaaggtaacaattaaaagcgttaggggtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagcgttaggggtgtgacgtgcttggaatagggcatggcacatggtgacctcccagggccttaagcagtgacagtggggagtgatatactcctatcctttctcgcccttctcaatgaagccagtttctctgattagcttgtcaatattgagcctttggggtatcttggttgcatttttagttacagagtgcgcttgcagaaccctctcttctccttggccgctggcagctgttctctgctctccctgcctctgtcgtgcttggcctcctcagcaagcctgttggctgtgggcgtccccagtactccgtctgcatgcacactccttggggagtctcagccacctgggttctggccccacctccaagctggtgaacctgggtctccacccagtggccaggtgccttctgccggacgcctttgcctgcctgtcccacactggctcctcctccaaggctccttgactgttggtggcagcaccatctgacctagagctggagtctttttccttggggagggggcgtcccttgcccttagtgatgttgatttctgccagtgggctgctgccgtcattcctgtcaccacaggttctgcatgggctttggctgacatcctcccctccagcctggccaatttcaccaggcccctccatgcttcttggaaattctcctttgctgcttgttttagctttaaggaaagccccgatgtctcaacctgaccatcagggttcctggtgactgtggtctctccttgtccacccacttccaatcataaaactggcttccccagctctggtgcaggcccttcaaattcatgggcagaggttgtaggcagacatgcattgcctttccctgcagtaagattttgaaccccatctgctttgaggctttggggttactgggcaaatatacccatccctgcctgtcagactgtacctaggaattttggagagcaaagaaaatccttgtttctttatggaaaaaggaattgatgtgagctgtgcttgggttgaagctgcttttatgtggagaatgcaggcttccgcaacacccaacatagcccaccctgcatcctgtttcccctcagcagccctcccttcagctccaggctacatggagccctctgcttgtttttaatttacaaacttacgtgatattcaccaggtaccaccttacacgttagctcacttgattctcatgaccaccctgtgaggtgggtactcttatccccattttacggatgaagaaactgaggcacaaggtggttaatatttggagttgccctctggctccagcatctgttctggcaccatgtgctttcctcttggccatgtccctcctgtgccttcttgaactggcccttaactctcatgtccacatgctcagccccagggctggggctctaagggagaggcccctggcagctgttcttctcttccaggattgtggctgcacggctcaacggttcccttgatttcttctccttggagacccacactgccctcagccccctgcagtttagaggtcggagggcctggggtgggcaggtgttcacacttggtgggacgggcaggggccgtctacccattgctttctcagagattcttcacttggccttttgtcctcagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgagtattgtcttgtctcttgggtgctggagtggcccggcacggggtgggagcctgatgcattcgtcagggagaggctggaagagtcctgatgaagaacagagggcatttcccagccaaagtataacttggaaaatcccagagaccagaacctgaggcccatccctgtcccaggtgttccgtctggaggactcgtgctgcctcttcacccttcagggccactcaggggccatcacgaccgtgtacattgaccaggtaagcggcctgcaggtggggtagggggtacagagtctgtggcccatgtttgctgactcctgggagctggtccccaggggccttccaggaagcagtcagggccccacccactggggcacagggacaccactgttgacagaggtattacaccatggtgaccccactcccctggcctgtttccccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggtagaggggatggggatcataggattcttgggattttagggaaggactcaggactgagcttgtcatgtccttgcctccaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtca

SEQ ID NO: 13960 - DNA, 7016 bp, Homo sapiens
ccacagaacagggtggtttattatttcaatagcaaagagctgaaaaatgtcgggtcccataaaggagcagaacctgacccagagcctgcagtacatttccaccccacaggggtgcaggctgggccaggcagggccaaaggcagcagaaatgggagtaagagactgtgcccactgagaagctctgctgggtgtgggcaggtgggcatgagatgatgatgatgtagtgtaaggaccaggtaggcaaaacctgttcaggtcttgttgagtgtccagagtggatccagaaggctgagggggtcgtcagagggccgggtggcccgcagcccttgcccgttatgggcctgcagaaagttatgcttgctcatccgctgtttgccccgcagggagctgtccagggagaaggcctctggggtcaaggaggccagcaattccagggaggaggaggggggccccgagctgggggcttcaggcactggcggctcctccttaggctggggagcctcaggtagtggggaggaaagggggggcggggaggaagatgggattggggtagactctgggaggctggctggcgggaggcctgggggctctgcagggcctggcaagctggcaaccggggactccaaccccccaggaggccgaatgctgagcttggcaatggtggcctggatggagctgatgggcacatccccaccgaggaccaggtcctgggagtcctgaggaaggtggttctgagaagacagagtgagtgaggagagggagtcccaaggctgtggctctcccagcagcttccacggaaccttcctcaccttctggctgatgcttgcactggccaagggtttgcatggaggaggcacaccatggcgctgcaggacctgctccacgtgtctcaccactgcctcatagcagaacctgaggtgcagctgcacaggtgcatttggccaggtcagctgggcaggggcccgtcaccctgggacagaaggcccatcccagccccatctgcccagatcctcaccttctcctgcagcatgtgctttctctgctgccgcatgcgccgcaccagctgaggcagctcagggattccgttcccagcctccacctcctgcacagctgcatagagcagtgcaaaggctcccgtgcggcccacaccagagctgtgccaagaaggggttatgaggccggggtatgaggctaggccaagagcccatagaggagagaccctcaggcccaccctctacctgcagtgcacaatgatgggcgtgtgcagcggccgctgatgcaggtaatgtgcgtgcacctcctggatgaagcgcagcaagttgctggggctgtcgggcaggcctctgtgggacaggatggggccaggaagagcctatgagccaggcctgacctgaggctctcatccctcccagcaccaaggactggacagcacttagacccccaaccaccatccagagcagtggactcacaactcaggccaagtggggaagtgcaggtgcacaagagagcgcttgaggctctggtctcggaactgcaggctcagcacgcgctccacatgggtttcggtgctgcggacgctgctcaatgccaggctcagggcaccgtgcaccatgggctggcccctctcggtggggaagtagcgtgccactttttgctgagggacagataagccaagacagacctggttttccaggatcccctgccctgccaccccacactgccctcgtgggcacccaccccctcttctcaccttctccatctcagcctcagaaaccagcatgacaatgactgacactttctgctcatggaccatgagccagaagtcagcagctgtgccaggcagtggggcctgggttgccactagcggggggcagtatggggagagcccctccacgcagctggcattgatgtagtcatccttgcctgagcgcagcaccacacggttactgtcatagggcatgacatcctggtgccggttcttcagtgagtagcagcgggcaatggcgatggaacggcctcgggcatcatgttcctgcgcatcttgcagctctcgccagacagtgtccagagctcccacatcccccagctgaccccgaaaggcctccagctcctgctgcaactgccgcagcctctcaggatgctcataggggtcccgctcaatcagccgcagggcctgcggccgacgaccctcagctgcatccaccttggtgggctgcagcaggggctgcccacccccaggagactgagtgccgccatgctggctctccgggctggaggagagcaggtctgcagctgcggcgcctcggcgcaggcaagggggtggttctgctgctggggggcgagggggtaccggaccaggccctggagatggggcaggtgaaggcaccaggtggggactaggggtggactggccagcagacgagggccctcgaatggtaagaggggctgcctgggggcccatgggtctggtagaaggggcaggaccatatgccagtgggggatggggaggctgagggggcccagggctggggaaaggcagagcccctgagtgggctggcagagggtcttgagcgggacctgggtagagctgggtgtgtagggggggtggcggctgccccaggaccccaggctgaggggcataggggtagggggattgtgggggtaggagtcctggggcctggggtgggaagagatgtggatgctggagtggaaggggctgctgtgggggctgaggcccaaacgcttgtgaaggatggggctgaggatggggctggggctggggcccaatccttggggctggaaaacctgcggggatcccagaagagaagtggtgctgtgccgggatgggttgcttagcccctgcagggtaggtgtaaggcgtgggcagtggctgcggtgggggcacagggaagcagggcgggggaggagcaggggtggggtttggccgtggggctgtgtggctggggatgggcgcctggatgctatctactgtggtggtggctggccgaaccgccatggccaactcggggcctgagaattgaggaggtggggccgaggggagacctgcaactggtggggccggccctacccccacatagggactgctcaccacgccatgctgtggggaggatcggggcacaaggcccagctccggtgtgtaggcaggggctgggtagagggcaggcccaggtgctacgggcattgcatggggccctggggccctgggctgtatcagctgggtggggcccgagtaggtaccagggggcaaggggcctgagagatagtggggtcctgggcctgtggagctggggaaggggctgggaggaaagtggagcggggtggcacttcccaggaaggtgtcaggcagtcgtgggccagccaccatgtcaggggggaggctgcgcagctcctcaggggggtctcctgcttccactgcctcactctcctccctgcggggcagcagcggctttggggctgtgggccgtggcggcggcttcttcttcagctccctgtgcgacaggcaaggaaaaagtggggccaggctcccatcaccccagcctgtctggacccgagccgcaccacagccccagggccacacaaacctgtccaggagctgctggcgggcagcctcgcgggcctggcaggtggactgcgtgcgctccagcagagcagccaccttgctctccagatctgcgtagaagtccctgccctcctgcgacttcttcatcaggtcctcataggcttcatacgaggccaccagggtctgcagcgtggagttccacctggtgggcagaagggccagctccaggtgaaccatggggctgggctccaggtggctccgggaaagagcagaggactgggcactgacttttggtccaagtcgctgagtacccgccgcacggctgcgtactgcacgttggcctctgtcagtgcacagaggacacggtcctgggcggccaggttctgctccaggtacaccttcagctggtcatactttttcagctgctcctcgaacaacttctgaggaaggggtgggggccagggacggacactcagggcctcgactcctaagggtggggcccggagccagagcccctctaccctgctcacccagcccaccttcatctctgagtggtctgtggtgaccagcgaggcagtgatgtcatctttctggataagctcacgcagctgctgctccagggacacgcgctggtcccgcatctcctgcaccttagccaggatgcgctttaggttttgcagcacggccttgtcctctgtgggcagcagtggtcagtgaggccagagaaacccccagctcgagtctcccaatggggtctggtggggctcacctggggagagggccggtgtgggcagggcagcccggacctggtcaagcggcccgctgagcaggcgcaggttgccgacgtgcaggttcatggcacggtgcagctcactgttggtgaaggaggccttctcatggacttccatgtacttggcccattctcgcctcacctctgccagctcagccttggaggtgatggagatggcccctgcctggcccaccgcctcctgaaacttctgctctagcagctcatcctcctccaacagatctctgatgtccttcagggaagcctccacatccgtgaacacacctgacagcactggggttgtggattgtacaggcagcccctgaggcaggctgaccgggcacccatgggcccctcccccaagagacagaaccgccccctcaggtcagggcttaagtgaggcccagcgcacactgagcagggtgcaagaggtatgctgattcagaggagtgggtgtggatgcccaagccagggcctagaggggtgcagcctccatcctcagtgaccagggacacggaggaggccacagcagatgacctccacactcccttccacctgcttgctctgccccttactcaccttgcatggactgtacaaggttcctgacagtgtcgggccggacgctgagagccgcgcacttctccatgagctggggtgggatgtggctgtaggcatcaaggttgtccaccgtctcgggatccaactgcattgaatccatgaactggctgtggggagcaacagggccaggtgggtgctgggtgctgatccaactctgaccatgtcaaaggagccgctagggcaagcctcaccactcaatctgaggtctcagcagagagcaaattgtgacctcggacccctactaccaggtctggcctggtctcacagaacatgcccagggcactgctggaaacagtggaacagaaggcacctcctcctcccaagacatgactcctgccttacacactagccccaccaccccaggcgggaaggcagcattgggaaacctgtttggaatggacatttcattcctctcccagcataggcagccctggggcccccagaggcccgggaagtgctgcctgcctccgcctccctgcccaagtcccacactcactccaggacctcattcttgtcctcaatcttggccatcatctcccggagcagcttggccttctcctcactgcagaagcgacagagcatttgctgaagacccacatctcaagacaccccacctccctctgtgccaccctccacccacctgtacagtgacgaggcctcgtgggcagccatgggtaccagtttggcaaagatgtcagggcctgtaacagctgggtctgtggggttcactggcaagggcttcaccaagggggctcctgggggggtgggaattgtggagatcaggcccacgcagagtccttgaggcagcctcctgtgtcctgtccccaccccaccgtcacctctgcccccacctctcagctccccgaccttttacaggctgaagagtgtccaatgctgggacagcctcatggtaaatgaagtcgttgtccttcttggcagaattgtacctggggatcaggagcagggggagtgggcagtcacggggtgtcagtggggatccagaacctacttcccatgtagatgccagcagagggacaagacccttcacaaaaagagggaaccagggccacccccacagactcactttcccccaatgacatccatagtgaagcgaagcgcgtcttgcacagtgtcaggctggccctgtggggttagggacaggggtggggccttagcactaaccaaggctggcaccaggacaccccctcagtcctaccgggcttgctcctataccctcagggcagccaggccttcctcagctttaccttggccaacttgatggcttcattgagcttgtccagggcgctctggaagtatgcaacctgtggagggtggcaggaaagcctgctctgtcctcctctgcttggaccctttctcctcctgcctcccacccggccctgcctgtccatcagatgacaagcagctcaggaggcagccgggcaccaccccagccaacagcagcaaggtggcgccacaccctgccccagccacctgctctgtagggagcctgccccacctcctcagaccccgagggacgagggctgcacagatgggacaacacttaagacaccaggcctccagcagggtgatggccagggtgagacagagaaggccaccccctggtgtgtaaggagcgggagcacaccggcatctcactgaaggctgccattggtccccagtcccctcctcgctgtagctcacccgctccccgaacttctgctgctcctcggcctgctttcccatgtgcagctgggaaagaagaagagacgccacgacttgcttcctgagctgtggccactcagccccgccctgccccgccctggggccccaggccctcacatgagccacggctgcgaagtagtagatcttcatctgcacaagtttcttccagtccttctggatccggcccagcagtgaggcagtgtcggggttctccaaggcccggcatgcctccttgtagtaatctaccacctgagaacagggtggggcccaatgagtgggggagtcagcagtaaagtgaaggcctcccct

SEQ ID NO: 13961 - DNA, 7279 bp, Homo sapiens
aacagaggaggcatacaatgacttcaggcaaagcagaaccttttgactcacacaacattatattattttgtcagctttatattttatgaaacatttttactatgagtgaggcaagagaaagaaaaaggaagagacagcatttggttatattacatcatttctaaaatctaatttcctggagtgagaatgacactaagggtacctacgagaacattccttcccatgtaaactaatagtgtaataaatactcatatagttactagttttagttgccaaacctagtttgtaaatggtaaatttgagaccagaactatattcttatgactatcagaccactgatagtttcactaagtcaactcccttcactaacaatttgattctacacacacacacacacacacacacaccagtttcaacaattttctcataagctttaaatcaaattgatgagagaactttccctgtttttctgtcataaactacattatctgataaagttcatactatttttacatacatagattatttaacatactttgcctctcttgctgcagagaactttgcttaagatatacagctgatctattctaatttcatgattatctatttatatttatttgttgttattgttgcttgaacactagttttcgagcagttttagagatgataccacttttacactgtttttctctgtaattttagttccttatggttcctggtataaacatgtaaaatcttggtgggaaaagggaaagagtccacgtgtactatttcttttctacgaagacctgaaagaggtgaggaactgggaacacataagcaacttggtaatttctaagatgttagcatttgaaaatactctggatacaaaaatattcctttaaataaatgatgacagccatctcgtaaatttttaaaaggaaaggaccaaaataatacagatactttagcatagatttgaagctagcaaataaaaatattctgaaaataaatacattttaaaccacaagtctcaaaaatttcaaagaaaaaatttgaaagaacttgacttcatgaatcaataacacacacacataggcacacacacacacacattcacacacaaggaatcaacatgggcaagcaattaactggtctgcaaatgtagagatgttgcaattgttagataggtcctataaaataaccatgcttaatatgtttaaataaataaaagatgaaattttaaaaattacaaagaaacaaaaactattaaaattgacagagcagatttgaaaaaaaatagccaaatacaatttctaaaaataactaaaaaaatatgaaaaattaagagatgggttcaataatagattagacatggctacatagtgaattattgaagtaaaagatggagctaaggaaattctatagaatgtagcacagtgagataaataggctatttgatgaaaagtaatggttcttactaagtattagcatttaaaaaataaaaatgtttttggtatataagatacagtgataatgtctcacatatatcaactcaaacttccagaagaagagtgtaaagagaatgctaaaatatcaatacacaaattttttatggccttaaaattttcttataatctaatttttcttcagctttattgttagtgtaattcaaaataaaaatcactatgagatacctgttttacacccactacactgataacaatttaaatatctgacaataacaaatattagaatgtgaatcagtgaaaagtaacacactgttgattgtagtgtagaaagatacaaacactggaaacaacttgtcattatctagcaaaggcaaacatgcacatagtttaagaccctgaaattctactcttagacatatactctagaaaaactctgacttgtgtacattaggttagatattcaataattttcatagtagcattcttaataactgcaaaaattgaaaacaacccagatatatataccaaagaatccatatataatgtattttattgtattacaattagatattatattataatgaaaggaagtacactaaaaatacacatcagctaggtaaaatcaaactatatgttgtctagagattcatacctaagtttgaaacctataaagtagagaagataataatttgaaattagcagtttttttccttttcttttcttttttttttttttttgattgttttgtttatgtgggatgggagtagaggtgaagggaactcaaaagaaaaaaaaactaagaaaactgtgaatgttctatttcataagttaagtagtaggtaataggtgctgtatatagttttcctctttaaatgagatatatacatatatctcataatttttaaaacatagaaaacataatgagtttctttattaagaggtgagaaattttctctattttcttatcctttactatcaccaaaaaagcaattgatatccatgtcttattcatatatttgaataacctttaaaatcctttatggtatttcagtaattttagagtgtttttggtgagcatttatttaaaataaaatcataaataatattttataaattaaattatgtatttatagaatttaacactagatcaaatttgaataagaaaagcagtcatgatctacagtttattatattatccaatactgtgttctgtaattagactattaatgacagtgaatttgaaatacacacaaacaaaattaaatagttactccaactctcttcctccatttcaaattgtccatgtctacttactcccgattttggtcaataatagccatgtttaggtttcctctatatttgaattaataaggctaagaatgtacaaattaatttttatttgtttctacaatgtatccagtagaaagaaatcaagacattatcactatatatatacacatatgtctgtatatataaaataagattttgtgtatatattatatatatatacacatacatgtgagatgcctattttgcacccatatatacatataatcttttttcttgtgtcttgaagcatcatctttttttaatttcaatttttaatttttatgggtacatagtaggtgtatatatttatggggtacatgacatatttttatataggccaccatgcgtaataatcacatcaaggtaaatgaggtattcatcacctaaagcatttatcatttcttcatgttacaaacattccaatgatagtttttaattattttaaaatgtacaataaattattgtctactgtagtcaccatgatatactatcaaatactaaatcattctatctagctctatttttgtacttattaactatccccacttctcttttgagtaagatagacaagtaaataaaacattacaaaaatacacatgtggtaaattagatttatttaaacaattatgggagcaaaacagggtcatctacccaaaattagaatagccaaggatattatcctaaataagttgataaataagctgaaatcgaaaaggcaaactacaatttattgagcagagaatttagaaacagcatttgattggcatagagagaaatgtgcacttgaatacacattgcggttagtattgcaaatagttgcactgagagatatagctgaataatggtgtatattataggagtggcacagatatggggatgtttgtagctatggtgtacagacaactgatgttgcattgtgagtatttgactttttacaccttttcttaatctttcttgtttctttgtttctcactaattacaccaataaattaggagaaaaatgaaaattgcctgtatatctttatcccccaaacttgatttttcacaggggactttaggttttgagtatgatgtttgttttcatagacaacatctattaagtgtgattatgcatcaaggactacaataagcattcacaaacatctcatttagttttttgaataatcttaaagtatcttttataagcattttatggatgaggaaaattatacttaaaacagcttttataaaattcccccaattagatttctcattagaaatctaattctaatatcagtaggagaaaagagaaaggtttattttttctctttcatttagatagtgatttattcagttttagcaatttagttctcaaaacattttctctccctaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggtgagaaaaatgtggtttgcctcgatactagaggaagtcacaaggtgacatggttataggcaaaaatctagtgaggtattttaatgcctatgaacccagcttaagttttcttcagcagtctttcatatttgaatacactctttaagttacacttctattacattgcaattacctgttgattatttattatatgcatcatattatgttaaaataactagcagactcctcaatctcagcattggaaatagtatcacactctactagctgtaatttaccaagcctatgtgcctcagtgttacaacatgtatcatatagttcctttaagttctaaccagaaattccgcagaaagattttattcctctctctttttgagttgaagaaataagtttagaatagtttgtcaacattttttaacaagtggcaaacacctttcaagggtaagtggcaaaaaatagaaattcaaatatagctctgtttagcaaaaaatatcaacatataaggagaaaaaaattctatttgaagggaaacatagcctgatgagatatagccagttaacaaatttaaaggcatgtaagatattcagatattcagagcactgggacaccagtctatttatatatgaggaagcagaaacaaacagaatagaatcaaatcttgctctttgaaccatactgtcagtgagagtcagggaatttgtaaaataacaaacctgccactggggaaaaaaacaaaacagaacagggatccactgaaaagagattcagttctcaaactatattttaattatgtactcttttgattatatgtttcctttttcaaaattctacatataaatgttacagaggacttaaaacagttgtcttgcttgcaaacggtgacttgctgctgtaccctcagaacctatctgatttttttaggatacacatgttctgtcttctggtttttgggttatttcagtgggaaagtttagagctccttgagcaagagggcaagtgaactcttgaatagtttaaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaagaaaaaaaaaaaagatgaattccttctgcaaggtgagtgttggaagtatgttaaaaagcaaaacaggaaaagcctgctggactattataattacccagatgagaaacactctctggctggcagtagcagaagtgtttaagaggcagtagatataaagaaagcctgaatataatgaattagatgttgtggttaagagaataacgtccaagcttatgtgtagatacctggtgttgactctacacaggtcattaaaatgtaaatggagaaaacacaatatgctaaggaataaaatgaatttatttttgaactaattgtatttggaaaatttggacatttttcaggtggcaaaatcatgtaggcagttgtatataaagcataagtctggattttagtgctatcagcattaagatgatatttaacaccttgagagtgggtaaaacatggatcttatcctgggagccccaacagctgagatgaaacttcagaagaaaaataaagtaaatggcataagaagaaagaatcagagaattaaatttgttgtttttttaaaccaattaggacaaatccatctttgtaagcccaaaaaagtatatcattaaaggtatacatttgattcctaaaattgagaattacaagtataatatttgattaggtgttaatgaaagtgatgaaattagcaaacctaatgattctttttggaagacttaatatttattgagctttcttttttgttacaggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccacttttcttatttagattgctagaaagtacataatcatggattatgttgacattttctttttaaattttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttggtttctttttcttttgcttcctcttcttcttttctattttttataaatatcatgcacaactataacctatgggaatgatgtagtaacccagattattcatcttgttagagttgtattaaaaataaacaagcatttcaaatta

SEQ ID NO: 13962 - DNA, 298 bp, Homo sapiens
tttttttttgagacggagtctcactctgtctcccaggctgcagtgcagtggcgtgatctctgctcatgctcactgcaagctccacctcctgggttcccgccattctcctgcctcagccttccaagtagctgggactacaggcggccgccaccacgcccggctaattttttgtatttttagtagagacggggtttcacagtgttagccaggatggtctcgatctcctgacctcgtgatccacccgcctcagcctcccaaagtgctgggattacaggcgtgagccaccgcgcctggccca

SEQ ID NO: 13963 - DNA, 15862 bp, Homo sapiens
cggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcgggtgagtgagagaaggaatgagggccgccggcggctgggcggcggggaggttgcagcgcctcctctcaggctgctgccggcgcctcgcatgcggcccggagtcaggataccagcatgcagccgggggtctcgccccatcccgccctggactttcccctgggagacccctcggctgccccgccccgccccaacctcggagacctccagtgccccgaagcaggcctgccctggcctctgggcctccgcaccccggcccggcccccacggttggtgaagtgcagactggctggggctcagccgcccagtcgcccagcgaccttgtagttacagccctcgccgtgacagtcgccttttacagcatcaaacacttctgttgattttctgcatcgggaggtccttagggccgagggatctcttaaacagttgaggaaaaatgggcagggatggtggcttgctcaagcttgcgcaggaagttagcaaggccggaggctaagggctcgcggactttgggcccaaagtccaatctttttttccagccaaatacttcccccacttggtgtcatttctttatttctgaaacggaggtgatcatttcttccacatagggacgttgtgaaattctctccgttacgcataattttgagccccttgtatgtgccaagcgctgtgctgggaaagttcgtggagcacccagaagtgctgtacacacggtccggctccagcaaagggtaactcattccagaggcaggcagagttggggtcaggagtgcagccctccccttgacagctgtgggcccgcgggcaagttacttccctctgggagattgtttcctccacttaaaatggggtaatgttgacccctagggtagctgacagaatgagttgttatgtgagacatgcttcgaacattgcacgttgtatatagtgcaatataatgcaataagcatttactgttactaagaaccctgaccaccttctagattcttaatttaaatgtggtcatgggcaacaaagcactttacagatatgcttgtgtaagggtttattgttactgaaggaaggcagtggcagtttatacttaaatgtaattatttattgagcatttacaaacctggctaggtgctactaataatatctgctgttgatagagtgcttcgtgtgtgccaagtgctgttctaaacatattcacatacattaaactcatttagtgcttatgccaaccgtatgggcaaaatatgatttttatcctcacttcacagatgaggaactgagacagtcacagagaggttaggagacttgcccacggtcatgcagctcgtaagtgctggtgccaggattcaagtatggctgagtgcttgtcttcaaccctcctagatcaccccctgtggtgaagttctattaccgttcattacgtgcacagttctcaaaataatcctatgtggtaggtactattgccataatatcctaatctccattttataagtgaggaagctggtgctcagcgggggttcagtcctttgcccaaagtcatatggcaagtaagtggcagggccaggatttgagccctggtgaaccacaacctgtatgtttccagaatgggcatccagaggctggggtctctagttctagtcttgccattaagtcatacggtgacctggagcggggggtctctggaacttggattaaaaagccctcacatagtctctacaggtccttttgttattaattctgatactaggcttgtatgtctttccttctgtttatagtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggtacgtaggccctcgttcctgtaggtttccttattttttgttgcaagggaccgagaaaaggatcaaagtcatccttttagtcattagaaatcagtgcagagccaggtgcactggtgtgcacctatagtcccaactctgcaggaggctgaggcaggaggatggcttcagcccaggaggttgaggctgcagtgaggtatgattgcaccactgcactccaggctgggtgacagaatgagaccctgtctctggggtgggggggaaaaaagaggacatttgaggtctgcctcaaatgagaaatagaggtttaccagcagcagggcaggaataagcaaatgcctggagtgggaactgcaattttcttttttaagagacagggttggcccggtgcggtggctcacgcctgtaatcccaccactttaggaggccaaggcaggaggatcacaaggtcaggagttcgagaccagcctggtcagcatggtgaaaccctgtctctaccaaaaatacaaaaaattaggcgggcatggtggcgcatgccttaagtcccagctactcaggaggctgaggcaggagaattgcttgaacccggcacgtggaggttgcagtgaaccaagatcgcgccactgcactccagcctgggtgacagagtgacactccgtctccaaaaaaaaaagagacggggtctcgctctcgcccaacctggagtacagtggcatgatcatagctctctggaaccttgaatgcctggcctcaagcagtcctcccttctcagcctcctgagtagctgggacgccaggcatgtaccaatgtgctcagctaattttttatttatttattttttttgtagagacggtcttgctatgttgcccaggctgctttcaaactcttagcctcaagcgatcctcccacccttgcctcccaaagctttgggattataggttcaaacagctctgcctgtccagaaactgcactttgtagtctggaaacttaagtctgatgtggccagcatggtacccctgtaaggcaaatagccagagttgaggctgggcctggtctggaaggacgttgactccaagttgagattgtaatgtatatcttcttatgtggggaccatcacagctctgtaaacagaggaatgacatagccacatttgtatcgtagagggagcataccagtggcagtgtgaagaataaattgatgagagatactagaggcagtggatgtagccagatcagattgagggaccgaggggtgggggtggccacatataaacacagtgtgtacagcagtgggacttggtgatcagttggctgaggcaggaggaggagagagaaagatgaagagtaactgggtgtaaggcctgccagctgggtggagggtgctgcttttaactgggggagggaaagtaggaagagagccttatgtaatgacttttggttcttctcagccacttaggattggcatatctgcctttggcagtacagggccaggggtggggtgatgcccatgggagcctgtctgcacagggagggttggctagcggatctaggagggaattagggcgttccttgaaatctttgtgttcctaatatattttggctgtgagttgggctacacgctgctatcactaccccctcaaaaaaaccaagaaacaaaacgccgtagagttaatacttcattcccacaacatatactccctatgcatcaaacactgcacaccctggggatgcagcagtgaatgagcccaaatgtcccccagaagcatatggtctgggggttaatggagtggagatgggaacaaggtgtggagcaagtacctaggacccctgtagattagttctccgcaccgcgtgatctcagggttcaaatcttggtcacatactttactgacacagtgaccttgggtcagttacagaaactactcagtttcttcatcctttaaatttgggataatattactgatctcatgggattgttgttgtgaggattgagggaattaataataagtgtaaaattgccagcacataatacacactcaatatctgctacctagtctcgtacatactcaagcaagataggtttataaaaaggcctatggctttttcaattaaaataagttggaactttcacacttctgtgctgtcatcctaggaagccgcaaggcctccattattcatcatccttaactatattagggtgatgagcatttctgttcccatttttgtatctagcgagacaggttaaataacttgcctgaaatattggcagagctgaaattctccatccctagttctgcccaccaggtctgtgttccttctttgttttttattttaaccatcttaaccattttaaagtgtacagttcagtagtagtaagtatattcacattgttgggtaacagagccccagaacccttttcatctggcacatctgaaactctgtacccattaagcaatggggttccttcatgacagtcccgattggaggtggagttcttacctgctagtaggctgtaagcttatgcagcagaacctgagtggagagcgtgtcatggagaagcagtttaaactggaacaagttgaattaacttttcaagtaaggtccgtgtctgtctgttgagcttgtggatgccgtcttctgttccaggtcaccaggtctgtgatgtcagtccgtccttggatggtgggcggggggtgcctattgcactacagtaggaaaagcctttttttcttgagatggagtcttgctctgtcacccaggctggagtgcagtgggtgcaatcttggctcactgcaacctctgcctcccgacttcaagcgattctcctgcctcggcctcccgagtagctgggactacaggcgcctgccaccacacctggctaattttttgtgtttttagtagagacagaggttcaccgtgttagccaggatggtctcgatctcctgacctcgtgatctgcccaccttggcctcccaaagtgttgggattacaggcgtgagccaccgtacccggccgaaaaggcttaacaagctggcccaacttaatagttttgatctcagctgttggctcacgcctgtaatcccagcactttgagaggccagggtgggcagatcacctgaagtcaggagttcgagaccagcctggccaacatggtgaaaccctgtctctactgaaaatacaaaaaattagcagggtgtggtggctcatgcctgtaatcccagctactagggaggctgaagcaggagaatcacttgaacctgggaggtggaggttgcagtgagccgggattgccccactatactccagcctgggtgacagagtgatactcagtctcaaaaaaaaagaaaaaatagttttgatctcaagtccaagatggcatcactgcgaattttcaaggccgttttagagcagtctcaaaaggtgcactgtcactcagaggacagtctgggttgctgactgacttctggaagctgacctttgtcctgtggatggaaatcttaaaagactagaggagaactcatttgtggagcacttttacagtttatagaccatccactgcaatacagtttataccgttcacatacaggattgcagtgaatggtttttcctcactacaaccctgtgatttggtcccacgcggggaccattatccccttttcgtagctgaggtgttaagtaactcatttgaggtcacccagctaataagtcagggctcaaggcaagttctgtatctcaggatttctgactctaaaacccacgctctgttctgtcatctgtagcaccaccttgctctcaccagtcatcagaagggcaccaaggactaaaatggtccagggaggctgcttctgccctgagtgaggaggtgcccttctggccctgctgcatcacactcaaggatcatttagagggcacatgtgtccagtggctctccctattgtaaatatttcagtaaagagttaaaacaagagacattgttatgtgtggggaaatgtatagtgttctgcttttctcctgattgggttatcttgcctctgctaagtttggtttgtcccgtctctatctcagtggccactggagagagggtgtctgctgttcttccctgattccacctgtaaatacaaacgttatctcttctccctggctttgctctgtgcatttgaggtgggaatgtactcggtttggcgaaatagtctttcatgtccctaaacctgaagcctctattgactgtaaatggtagagaaaaggaaagtacccccaaggtgtgaactctagttagggaaaaaaatatttttgggcttgacagtgactcttagttaactcaattactggaataatagagtcagaaatatttctttgtttttcagggaggtagaggcaggagcgtaagatgtggaagctagaaatatccacttgtaacacggtattagaaggaatgttattttacatggaagataatcctcagtgatccttttttttttttcttcaagacggagtcttgctctgtcacccaggctggagtgcaatggtgattctcctgccttggcctcccgagtagctgggattacaggcatgcaccatcatgcctggctaattttttgtatttttagtagagatggggtttcactatgttggccaggctggtcttgaacttccgacctcgtgatccacccaccttggcctcccaaagtgctgggattacaggtgtgagccaccgcgcccggctgatcctgtctcttgatgtcctcccattctgggacgctaaatggtatccgactttgttttcccttatgtcattcctggtgtgaaggacacgggatattatagaggagagtggcagcatgctgagtggtattccgatctgaatcacactgtcatcctttatccggctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcaggtgaacacatttttagttcctcttccaggtgtaatcgagcagatgggtgttttgttttccagttagcagtcgagtctgcagtgtcctttgtgttttttatctcccggtataccagtctcacctaagcttttatagtccccgctgcgcacttctctcaagaaacaaagcatttgtcaagtaggagggtccatggagggacctttctcacatatggacgtgtagtttcagttccgtgtgcaggatgtttggtacatgttgttttgtgttttgtttgcagaaagtagatagaataagggccgatttgatttgggtaagggtgagcatggtacagtagaaaaagcgtcatacaaggagtggggagtcctgagttctggagatgactgtgtcgttttgttttcgtttttgagacggagtttagctcttgttacccaggctagagtgcaatcgtgtgatctcggctcactgcaacctccgccttccgggttcaagggattctcctgtctcagcctcctgagaagctgggattacaggcatgcgctgtcacatctggctaattttatatttttagtagtgacggggtttctccatgttggccaggcttgtcttgaactcctgatctcaggtgatccgcctgcctcggcctcccaaagtgctgggattacaggcgtgagtcaccgtgcccggcccattttgtttttttatttttatttttaagagatggggtctcactctgtcactgaggctagagtgcagtggcgtgatcatagctcactgtagcctcaaactcctgggctcaagcattcctcctgcctcagcctcctaagtagataggactacaggcatgtgccaccatgctcaatttatttttatcttttacttttggagatgggggtcttgccatgttgctcaggttggtcttgaacttctggccacaagcgatcttcccacctcagcctcccgggtagctaggattataggcatgagccactgcgcctgtaccatttcttttctctgagacctgacacatcacctccctatgttgagaacctctgtgtgaggtgatgtgatggcattagatgagctccaaggtcccgctcagatctaaccttccacaaagtagtggccaaaggacgaagaaatgacctgcattataacccctgtgatggggtagagagacctgctttataacctctgtgaaggggtagagagacctgcattataacccctgtgaaggggtagagacctgcattataacccctgtgaaggggtagagacctgctttataacccctgtgaaggggtagagacctgcattataacccctgtgaaggggtagagacctgcattataacattgtgaaggggtagagacctgcattttaacattgtaaaggggcagagagagggctgttttgcatggtggggtacttcattgtaatacaaaaaaggactgacactgagcttaatgctttcttaatctcactagcttggggaaagttttcctacaatacccaagatcagcccctcctccttgcatcctgatctatcatgggacattgtagctccctccagaccctaaagcatgcagtgctggaggcaagaagatttgggttgctggaactcacagagtaccctgtacttgttggggtttggcttgttaggggagggaggttcttggggtcccagtacttatggccgtgttctgtcttcattctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcgggtaagtgcatgcagccagggctgggggtggaatgtagtggtatggtcataagatgtaatgttttatagaaagaaaatgtcgaagcgttctaggaggaaatgatcgcaatgataagtgaaaaaaacaggtttcaaaagtatgtatagagtgatcgtcattacatgcatctagaaagaaacataccagatattacaaacagttttctctgggtcatgacgtggattatctatgtcttatatcatgtagtcttccctgagattttctgcgtggagcaaagtattctataatctaaaataaaaacaaaattactaaaagaacttactaggacagagcttctggggaggaagtaaattggaaggaaatagggaaagagggcaggtttatgtcctgtgtcctctctgctatttcagatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggtgagaagggctgctgcccctcctgggacctctctggactttcagtaccactcctgcactcagcagatgtttcctgagcacatctgtgccaggcactgtgccagcacttgccctccatgccaggcccttctttctggggctgaggcagctgtggactgagcaggcatgggcagagctcacgtgcctctctctcttgccttggcagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtaacaaggtggttctcatggtgggtggggtttgagtgctgagcaccatagtgttgttggcacagatcagtgtcccaggcttgccagaaagactgaggtcttacagcttccgaatcctgtgtacctcagcagcatttggagatccatgcttgttattcttttttttttttgagacggagtctcactctgtcgcccaggctggagtgcagtggtgcgatctcgactcactgcaagctctgcctcctgggttcaagcgattctcctgcctcagccttccgagtagctgggattacaggtgtgtgccaccactcctggctaatttttttgtatttttagtagagacggggttttgccatgccggtcaggctggtctcgaattcctgacctcaggtgatccacccacctcggcctcccaaaatgctgggattacaggcgtgagcctggcctgttattctttattcttgtgtctttaatcgtttctcatgttttagtcctacttacaacttctaggaagctataagaggcctcctccttcctatattcttgtgcccatctctcctttctagttttctcactctgtgtagattgcatggtgacatgaaagaattttttttttttttttttgagatggagtcttgttctgttgcccaggctggagtgcagtggcacgatcttggctcactgcaacctccgcctcctgggttcaagcaattctcctgtctcagcctcctgagtagctgggattacaggcacacgccacaatgcctggctaatttttttgtatttttagtaggggatggggtttcaccatgttggccaggctggtcttgaactcctgacctcaagtgagccagccgcctcagcttcccacagtgctgagattacaggcatgggccactgcgcccggcctagagttcccattcttgctgggggggaatgtaagatggtgggaaccgtcttagaggaagcatgtcttttgaacagagtaaaccctcaaaaccctttaaattctgccctgacaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaaca

SEQ ID NO: 13964 - DNA, 279 bp, Homo sapiens
gaaatgccaccaattatatttatttgggtcacaaaattctttaaaaagcaaattagggcagcctgaaagagtggaaagaacacacatttcagagtaagacagacttggcttccactgaaagcttctttccttcttagctcagtgtcttagaaactactatgcctctctccatcttggttttcttttcttttctttttcttttttttgagaccgagtcttgttctgtcgcccaggctggagtacagtagcgtgatcttggctcactgcaacctctgcctc

SEQ ID NO: 13965 - DNA, 5755 bp, Homo sapiens
gaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgg

SEQ ID NO: 13966 - DNA, 5659 bp, Homo sapiens
attgggttgtatacttactgattaataataagagctctttacatattaaggaaattaacccttttcaaatacattcctatttctcactaatctttaagttttattgtaatattttgctctttagtttatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccttagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggaggctgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttacaaaaaaaaaaaagtgacttgatttaggggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcccgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccggcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgg

SEQ ID NO: 13967 - DNA, 3761 bp, Homo sapiens
attgggttgtatacttactgattaataataagagctctttacatattaaggaaattaacccttttcaaatacattcctatttctcactaatctttaagttttattgtaatattttgctctttagtttatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaaccagaaaaaataacctagggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaacccaaaaaaa

SEQ ID NO: 13968 - DNA, 1608 bp, Homo sapiens
ctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttcc

SEQ ID NO: 13969 - DNA, 1508 bp, Homo sapiens
ccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgt

SEQ ID NO: 13970 - DNA, 1608 bp, Homo sapiens; identical to SEQ ID NO: 13968

SEQ ID NO: 13971 - DNA, 2223 bp, Homo sapiens
ccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtaaaagagagaagttgtggagaaatgggggggctgattctgctcagattcatcagtatgagtagaaggcacccagctctcaccctggcctgacatgtgtgtccctgagcaggttacagtcctctctgagcctctgcttcccatctggaacctgctggggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattcctgttcagatgaaaagatttgtgcctttaatgataaaagtgatctgcatagagtcaaa

SEQ ID NO: 13972 - DNA, 1608 bp, Homo sapiens
ctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggctgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggttttgatgtacatgggcaagtatatctgtgagagaaaagtttcctcaggaggaattctgggcacagcatgtgtaaatttctaaatatgatggacacccccagcttccacctcaaggaggttggtcccattgacatttcc

SEQ ID NO: 13973 - DNA, 1522 bp, Homo sapiens
agcaagccttcaactttcgcagagaaaatgctcaaaaacttcagtttcagcagtgcccagcaaagggcaagtgcggtcttcaaggaggagctgggagatgatgaacgatgggaggcaagcgtggggactggcgggaaggcgggagcagctgaggggatcccagtggacccaaactacaagttggggcttgcagggagcctctgctgaaggtagtaggaaatgtgcttcttactgctcccttgtcttctctaatactcctcttagttcttttcctcttgcataccttttatttctggctaagtgttgggcattgttgtacattttctagcttgactcccttgggcaagttactttctgtctctgtgcctttgtgtcttcatgtttaagatggaaagaactgcagtgttgacctcctagggctgttgttagaagccattgaagacacagagaatacttagaataatagttggaacttggcaggccctgagttaattcactgccatcattgtcctcgtgcttcatagcagtagccgtgttgctgctcttagcctcagttctttcatgggcttctttcggttccttggaggctcccaagcaaaggtttttcagcacctctgttctgtgaaaaagagattaagcattttcagtatatttaaagttatctccagcctattgtgatgatgccttttctccaaaacccttttttattttcgttttattgtaggcacaaatctttctaatgcagatgcttaatttttcccaaaaagcaacttactcctttcaacaaggttttctatttggtcatcacatctgcattcttccaagaagcccactggtaaataatggaacaatgaagcagtgtcgccactaaagagtaatctgcaaccacacagaagctggaatcccaagtacctgtcattatattctcctacacatgtgcagagtttgataaaaagagagagccagttttattattcctttaagaggaaaaaactgccaagaactcctaagctttaattaccaaaataagcttgccttaaacaaattcaaacacatgaacacaaagtagaagatcaaatgcattttgtggccccatgcacatatatcttccatgagcttgtatcttcaaggtaacagtgctgcgtctttaatacccattagcgctgcactgtctaaatggtgcacgccagaaaagagccgtctctaggtgtctcaatgaaccatgaaaaatctcagggaaaatgtattaatatatttttcagcaaatcctttgagatgaggattctcaggaaggattttagtgcattatgcaatgtagttgaattccctcttcagtattgaatatgctttgctttattccaaagagctcaacctcttcctatagacattgaaattcatctgtttcattcatagcaccacgtaaactttttatttttgtctcaaacttctctgataagcttgcctctgcatacaaaaacatcaaagcctgtggtgaaaaattattagaaaagaaaagagaaaa

SEQ ID NO: 13974 - DNA, 5137 bp, Homo sapiens
ctaatttcatagagaacaggtattacaagatctatagctttaaaaaaagaaacctaattctaaaaattagaggaaatgactcaactctcatgaaaaatcttttgcaattctgatttctcagttattagatgaattttcatatcttacatacttctttattagtctcaaacatttgtatttttctattcctcacttctttcctaagagatgtagatacaatcaagagaagttccaaatgcatgagcttgaaccagtggcttacaatgcagctaaagctcttgtcaatgaaggccagggttcttgtcagtttatctcaaatttctacaaggctactaaaattaaccagggagctgtgtctccatttttatattcttattgccccagccaaattctgatatagctaattgcttgtcccccacccaaaattctcttctattttggttaactcatatctctctgcatgatctaagcttcataggtacccatacccactagagctctggccattgggcaaatgtactgcatcctagagatggcagtatatgttaataaagagcctttttgagacccttgagaaggaaattcactagcaatttactaagaatgaatgcgcttttgttctggtagggcaggctttgtggaaataaacaaccaaaggagaaaagcaaaggctgtctattctgagcttcctatagcaagggggctggccattatcacttgtgttttggcagagacttaaaggcagaagagtggtaaatattatagtggagaaaagggaagcttcagttgtgccctaattggaagctgatagcacggagatgttatgagccaaccagaagtggagcacccctggtgattggttggggtgtatgcctggccttctctggttggtcctcagttggaagcagagacaaaaactagggaagctttcatttatgaatcacgtcctggccatctggggccaaatgttgcacaagttctgaatagagatggcaatctgtctttctgtgaaactaatagcaggcttgcttcctgagttgcttattacaggtaaggagttggtttcctgggcaggatgctcaggttgtgggtcaaagttctgtttttatgcattgtctgaccattgtccatttgcatattcagtctctccatggggacatatgtgagagttataacgtaatagagctctggttccaaattatactttattttaaattagtttttagttaattgtcatgaaactaaatatagccaggtaattttgagaaaattatctattattagtttttctccttctggtactacatctataagccatttgtagcagtagatacaaattgtaaaggaaatcattgtggaaatgtaagaagcaggcagttaaccaaagggaaacattgaacgtagcttagtatctccttggacctcttttcactgggacctgaggtggtggacacttctgggtgtgtttcttgtagggaaggtgttattgactctgggtctcaaggcctagggaccaatagacctgggtggaaaaagaacatggcttgaaagtagaaagaaatctaccagaaattggtagaaagggaagaagaaagagcatccagttaaaattccataggctaaaatatacatgcacaattgtatcctctaaaccacattaaaaacaagttttcaggaatagattattgaagtagcactttgttcaacttgctagactccttcactgaaattggttgggcactactatgagcctggcactggaaatatctccattcttatttgttaacagtagtctgtatgtagcaacatggacagaagagtatttccctccactaagacagcgaattgcttgtggcttacaaagttagtatttaaatgaaactactaactcccaggaggtataaatggtgagatatttccccttaaggaaaaagcactttttatgttgcttttgcacaagtggtatgaaacccagttatttattggacacattccatgcacaaaggggtgggtttgggtgcctggataatggatagcatttccagaaagaaagttcagaaggaatttcaagaagccttgtaatgagggatagatacactcacctacaatgcaggggagatggttggtgcacctgctgactggggtaaactcgcaggcttgccagggtatccgtggggagggtgatatttccttggcactggagagttatcataacacatttggcaagccttacattttcattcattaggtttctttcattaggttgaaagttagtgtactgtctgtgccaatgcatgtttagacatttatttttctctgtgcaaatgttcctactattgcactccacagacaagtgagaggaaatttgacaagcaatttgtattatgtcagttttaccaaatcacacccttgtcctcccctctaatcacacaaaagcctccaaaagcccatgaggcatgacgttccaggagcttaggaggttattgaggcaggtgagaagtatggaatagatatcaggaggctttagcaaaaaggatcctccctttagctccttgaaatgcccatcccttgactttcagaaggtgacttaccttcccccatttccagcagtgacctcgtcttacctcggaatctctagagcaatagctttcaacatggggcaattttgtcccccaggagatatttagcaatatcagaaaacattttttgttgtcacaactggtgtggatgggagggtgctactggcacctagtgggtggaggccagagctgctgctgtctgtcctgcaggctatgggacagcctcacaacacagcatggtccagcccaaaatatcaacagtgccaagctggaggaacccggctccagatcttgtacagacgtctctcaaggagacctggaaacctggcaaattctgtctttctccaaaagaactattccttccaatctttttcagtaggcatagattatgtctacacatatgtgaaaatcacaagtctagtatgcaatccagccaaatgacactagctggatatagcactgctgtgaccctctacaaatctgtgcttgagttgccatagatgactctacctgtcagctcaacacaggggcagtgtggggcagggatgttacatggctcaactgtttaagttatgcatccatggggtggatggttgcaccattagagaatattccagaaactcttctgtggctaacgctctctgaaacatttccttctctctgcacagaccctgctgtttcccaggcaactaaatgcagtacctaaaaatatatgcatgcaagatttttatggggaaataaaacaatatcacattaaatttaggactaatatttgagatcatgtaaatctctgaaggcagctaccctcactcagggaatagcttatgcttcagtcttagaaactaccttgggatacctgactgtttgccatggtttggtttgggtggggtcctgttttatttgttcatggctaagtagatgcagagattggatgacacttcattcagggcagtgtttgtagaacatggaccttgatccaggccagttccaggttctgggagctcaggtgataaagagcctgtatttccttgcctcaaggagggtactgaagtgaatggacccttgtgctgtgctagaggaatgccaggatttggggatggtgaagcggccagcagaagcagctttgggaggagcgatttaggaaagcctccctaaatggtggaacccctgaattgagcccggagaagttgaagttaaccagacaaaggagcaaacaatgcaggaagcgaaaacaacaggacttaaacctgagagtcccatctcctggagcatatttacaaaattacaagcagggtcacctgctaggaacacagcagctccccagccctgcaggggtcctgttggccagtcccaagagctggtattttacctggtaagcaagagggagctagcgacatgacatggtcaacagaaaaaatggcactcacagtcttgtgcccccagcctacttctgctaggattgaagtatgtgatttgtatttattagggtgacgctggacctataccagagcagcaagcaatggaatacactgatctttctatgtttttattgacctgctgataaacgaaagtcacggcacatatgtatgcatgtatctgtgcatctgtgtgtatgtagacatggagccatactctttatacccctaaatatacacatatcctgtccctctctccgtcccttccctagccagcacaccccttggtggataattgtgtctctttggtttaaactcagaccccaaaacaatgccttttacgtgggaaaacaatacaaaaggcatttttgccatcgctgttggtggggaactgtatgtgatgtgattgggtccctgcgttcctgtagaaccagttgcccagtcccgcttcctgtgacatcatcctcctggacaggcagaggtgtgtactggcagctttccctgctttctgaagcagccggagtgccatgtgcaagtaatctttcatttccaagatgaagagcctgtgtgcacactcatctctctgagagaagcatggctttcacagaggcactcacggtcatgaaactcagctcattaaccctccggaaattcatgaggaggctctgctgagaagagtcactgatgacagaattttaaactttattttctgtccccaataatgttggtgattatgcccatgaaaacgcatgggctttctgtggctgtcaaggactttctagagaaattggtcttgagcttgccatttcgtcagtgctggctctgtgctttgttaactccagggagcttgaagcctgtttttttgttgttgtttgttttgttttgttttgttttgttttaacagatttggacaaaacagaatccagtggtagtgacagtgatgatggcagccaatgtgattaactgaagcatcatttttatttattttatttatttgcttttgcttatttggtcttaaataccaagttgagatatcattcaatgagatttcagacagcgttaaaagtgaaatggcaaattccgtgggattccatatgactgatgagacatgattatttgtcaaataaagcaaaatagaactgt

SEQ ID NO: 13975 - DNA, 4838 bp, Homo sapiens
agtgatgatgagctttttttcatatgtttgttggctgcataaatgtcttcttttgagaagtgtctattcatatctttctcccactttttgatggggttgtttgtttttttcttgtaaatttgttgaagttccttgtagattctggatattagccctttgtcagatggatagattgcaaaaattttctcccattctgtaggttgcctgttcactctgatgatagtttcttttgctgtacagaagctctttagtttaattagatcccgtttgtcaattttggcttttgttgccgttgcttttggtgttttagtcataaagtctttgcccatgtctatgtcctgaacggtattgcctaggtattgttctagagtttttatggttttaggtcttacgttaagtctttaatccatcttgagttaatatttgtataaggtgtaaggaaggggtccagttgtagttttctgcatatggctagccagttttcccaacaccatttattaaatagggaatcctttccccattgtatgtttttgtcaggtttgtcaaagatcagatggttgtagatgtttggcattatttctgaggcctctgttctgttccattggtctatatatctgttttggtacgagtaccatgctgttttggttactgtagccttgtagtatagtttgaagtcaggtagtgtgatgcctctagctttgttctttttgcttaggattgtcttggctatatgggctcttttttggttccatatgaaatttaatgtagtttttttctaattctgtgaagaaactcattggtagcttgatggggtagcattgaatctataaattactttgggcagtatggccattttcacaatattgattcttctatccatgagcgtggaatgtttttccatttgtttgtgccctctcttatttcgttgagcagtggtttgtagttctccttgaagaggtccttcacatcccttttaagttgtatacctagatgtcttattctcttcgtagcaattgtaaaatagattatttttcactgtcacttcttttaccttctagttaccatgttatttcttttcttcccatttcaactctcctcaaaagagttatcttcatttcctgtcttcattttccctcttccctttcatatatattaatatgccctctctccctattctttatctctttctgtttctctttccctatctgcccatctccctctctgtctccctcttcccacttccttctattctctcctctttctgtcccctcccctcattgttttacacactactgaatcttttccaatcaagctgtcactcccacccttcacctcccacacaaacaccccatcacactactctggtcaagttccagtgacctgcacattgccaaagccaatggtcaattcctagtactcatattactcaacctatgagcagtatttgttacagttccctccttctttaactttttccattggttttccaggactcagtactcttaatagctttcctcctaaatatccagtcgttctcagtctccttttctgcttccacctcttctttacaatttctaagcattagaatgcccccagggcttagtccttggactttatctatgcttactactttgctgacttcattcattccatttaaatactctgcctatactgatgtctcctaaatagcaatagaaataatctcagcctcctccctgattttgttggtccagatattactccttggatgccttattagcatctgagatttaacaggttcaaaattaagctcccgatctctgccctaccctcacctcaatttactattttcacagtctttctcatgtcagtaaatggtaacttcatcttttagttaactggaccaaaactggcagagttatcctcagcccttctctttccctcctgtgctttatccaaactcttaggaatccagtcagctctatcttcaaaatatagctgctaccccatagtacttaatcatcattggatataaattccatgtaatcatcttgtttactacctgtgcaccacccacctcccctatccaccctccaggccccagcaacataagctctatgacaatatggagttccatcagtctcagccaatgtgtaggaagaggcagatgaataatattgaaccaccattagcatggcacttctttacttcacttctttactcctaatacctagaacaatgtctagcacattgtatgttctcaataaatatttggtgggtggttagagggatgaatgcatgaaaggatgaaaggaacacatgaaaggaaggaacatcaaaggagctgagcttgagtcttccctttgccctttattacctgagtgactttaggcaagtcagttgatcttcactgaacctttcgtcttatttagaaagttaggggataaaataggtcctattctgataaaataggtttgttctgagaatcagatgagagaataaacatatattttcttgataactagaaagtcgtatacaaatgttagtcatgataaggagggagaaaaggaagggaaagactcgagggggctaatggttgccaaatgagagatcagggacacagaaaacagttttcttcacagttttgagtatttctagacctgggtatacagggttttttttttaattttattattattgtactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagttcccggtgtgtgatgttccccttcctgtgtccatgtgttctcattgttcaattcccacctatgagtgagaacatgcagtctttggttttttgtacttgcgatagtttggtgagaatgatggtttccagcttcatccatgtccctgcaaaggacatgaactcatcattttttatggctgcatagtgttccatggtgtatatgtgccacattttcttaatccagtctatcattgttggacatctgggttggttccaagtctttgctattgtgaatagtgccgcaataaacatacatgtgcatgtgtctttatagcagcatgatttataatcctttgggtatataccctgtaatgggatggctgggtcaaatggtatttctagttctagatccctgaggaatcaccagactgtcttccacaatggttgaactagtttacagtcccaccaacagtgtaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgggttcattgtagattctggatattagccctttgtcagatgagtaggttgcgaaaattttctcccattctgtaggttgcctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttctgagagctctgttctgttccattggtctatatctctgttttggtaccagtaccatgctgttttcgttactgtagccttgtagtatagtttgaagtcaggtagcatgatgcctccagcgttgttcttttggcttaggattgacttggcaatgcggggtcttttttggctccatatgaactttaaagtagttttttccaattctgtgaagaaagtcattggtagcttgatggcgatggcattgaatctataaattaccttgggcagtatggccattttcacaatatttattcttcctacccatgagcatggaatgttcttccatttgtttgtatcctcttttatttcactgagcagtggtttgtagttctccttgaagaggtccttcacatcccttgtaaattgcattcctaggtattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctgattgccctggccagaacttccaacactacattgaattggagtggtaagagagggcatccctgtcttgtgccagttttcaaagggaatgcttccagtttttgtccattcagtatgatattggctgtggttttgtcatagatagctcttattattttgaatacgtcccatcaa

SEQ ID NO: 13976 - DNA, 1308 bp, Homo sapiens
cacactactgaatcttttccaatcaggctgtcactcccacccttcacctcccacacaaacaccccatcacactactctggtcaagttccagtgacctgcacattgccaaagccaatggtcaattcctagtactcatattactcaacctatgagcagtatttgttacagttccctccttctttaactttttccattggttttccaggactcagtactcttaatagctttcctcctaaatatccagtcgttctcagtctccttttctgcttccacctcttctttacaatttctaagcattagaatgcccccagggcttagtccttggactttatctatgcttactactttgctgacttcattcattccatttaaatactctgcctatacggatgtcttctaaatagcaatagaaataatctcagcctcctccctgattttgttggtccagatattactccttggatgccttattagcatctgagatttaacaggttcaaaattaagctcccgatctctgccctaccctcacctcaatttactattttcactgtctttctcatgtcagtaaatggtaacttcatcttttagttaactggaccaaaactggcagagttatcctcagcccttctctttcctcctgtgctttatccaaactcttaggaatccagtcagctctatcttcaaaatatagctgctaccccatagtacttaatcatcattggatataaattccatgtaatcatcttgttactacctgtgcaccacccacctcccctatccaccctccaggccccagcaacatacgctctatgacaataatggaggtcccatcacgtctcagccaatgtgtaggaagaggcagatgaataatattgaaccaccattagcatggcacttcttcacttcacttctttactcctaatacctaaaacaatgcctagcacattgtatgttctcaataaatatttggtgggtggttagagggatgaatgcatgaaaggatgaaaggaacacatgaaaggaaggaacatcaaaggagctgagcttgagtcttccctttgccctttattacctgagtgactttaggcaagtcagtggatcttcactgaacctttcgtcttatttagaaagttaggggataaaataggtcctattctgataaaataggtttgttctgagaatcagatgagagaataaacatatattttcttgataactagaaagtcgtatacaaatgttagtcatgataaggagggagaaaaggaagggaaagactcgagggggctaatggttgccaaatgagagatc

SEQ ID NO: 13977 - DNA, 1308 bp, Homo sapiens
cacactactgaatcttttccaatcaagctgtcactcccacccttcacctcccacacaaacaccccatcacactactctggtcaagttccagtgacctgcacattgccaaagccaatggtcaattcctagtactcatattactcaacctatgagcagtatttgttacagttccctccttctttaactttttccattggttttccaggactcagtactcttaatagctttcctcctaaatatccagtcgttctcagtctccttttctgcttccacctcttctttacaatttctaagcattagaatgcccccagggcttagtccttggactttatctatgcttactactttgctgacttcattcattccatttaaatactctgcctatactgatgtctcctaaatagcaatagaaataatctcagcctcctccctgattttgttggtccagatattactccttggagaatttaatagcggtaccgatttaacaggttcaaaattaagctcccgatctctgccctaccctcacctcaatttactattttcacagtctttctcatgtcagtaaatggtatacttcatcttttagttaactggaccaaaactggcagagttatcctcagcccttctctttccctcctgtgctttatccaaactcttaggaatccagtcagctctatcttcaaaatatagctgctaccccatagtacttaatcatcattggatataaattccatgtaatcatcttgtttactacctgtgcaccacccacctcccctatccaccctccaggccccagcaacataagctctatgacaatatggagttccatcagtctcagccaatgtgtaggaagaggcagatgaataatattgaaccaccattagcatggcacttctttacttcacttctttactcctaatacctagaacaatgtctagcacattgtatgttctcaataaatatttggtgggtggttagagggatgaatgcatgaaaggatgaaaggaacacatgaaaggaaggaacatcaaaggagctgagcttgagtcttccctttgccctttattacctgagtgactttaggcaagtcagttgatcttcactgaacctttcgtcttatttagatagttaggggatggaataggtccgattctgataaaataggtttgttctgagaatcagatgagagaataaacatatattttcttgataactagaaagtcggatgcgaatgttagtcatgataaggagggagaaaaggaagggaaagactcgagggggctaatggttgccaaatgagagctc

SEQ ID NO: 13978 - DNA, 149 bp, Homo sapiens
ttttttttttaattttattattattatactttaagttttagggtacatgtgcacaacgtgcaggtttgttacatatgtatacatgtgccatgttggtgtgctgcacccattaactcgtcatttagcattaggtattctcctaatgctat

SEQ ID NO: 13979 - DNA, 2396 bp, Homo sapiens
gactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgtc

SEQ ID NO: 13980 - DNA, 2396 bp, Homo sapiens; identical to SEQ ID NO: 13979

SEQ ID NO: 13981 - DNA, 671 bp, Homo sapiens
tgcaggctggtgacgcgccctctgtgggtgggagctgccgctcggaggggacgcgcgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccgggtaagcgcaggggcttcttggatggcgggggaggatggtggaaagaccactgggatgcgacgccttaaaagtggagtggaacccaaaacgggttttggtttgctgtgctgctatgaaagtacacaaaagtgtgctgtgtacactttgtgattgcctctgaaattcgatgtggtttattctagacttgggtgtggtgtaggcagggcctacatccaaggagctgattggtcaatgaaggcgcctccctctcattggtctctgtggctgtcattctgtcaccctcctccctggctctttgccctcaataaactggctcaaagagccttggaaaagcattttattcccagctcttatgcgaactctgtgtagaccctggacaactaaatctgctttcccatttgcaaaaaaaaaaaaaacc

SEQ ID NO: 13982 - DNA, 2234 bp, Homo sapiens
tgatcaccaagtgtgaacagaatccggaatgcagtttcagcgtgacctgcagtcattcatgttcattggatttgacagatggaaaccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaa

SEQ ID NO: 13983 - DNA, 19509 bp, Homo sapiens
  misc_feature (19397)..(19397): n equals a,t,g, or c
taagtagctgggactgcaggtatgacgaccacgcccagctaattttcttttattgtttttatagacagtgtcttactatgttgcctgggctggtctcaatctcctgggctcaagtgatcttcccaccttctcccaaagttccaggattataggcatgagccaccacgcccagctaaaaggtgtttattttttattgtaattttgttttgtcattgacagattttgaatttctctttcttaccctcttcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgtaagtttcctttcctgccactcacgcagaaacctgggtcctgcagtcaatagaagtgggttgtattggtctgttctcatgctgctgataaaggcataccagagactaggtaatttataaggaaaatgaggtctaatggactcacaattccacatgtctgggaggcctctgcagaaggcaaaggaggagcaaagccacatcttacatggtggcaggcaagagagcgtgtgcaggggaactgccctttataaaaccgtcagatctcgtgagacttattcactaccacaagaacagtatgggataaacttgctcccatgattcagttacctcccaccgggtccctcccacgacatgtgggaattatgggaatacaatacgagatttgggtggggacacagccgaaccatatcacaggttgagaaccctgccaaagttctcaatgttgaacctgccaaggttcaaccacgattcggggttgtcctccctgcgaaggcacacacatcttctgacccaagggctgaggactcttggcctaaatgtgaaggttcaggccgtcccatgttcaggttttggtggcaggtcctggcaggcagggacgtttgtcctcccatctgtgattctttcatagagcctggctctaggaagccctttgaggatgttgtgtgacttcagctttcctctagatcagagttctcaaccttgccactattgtcattttgggctggataatcctttgttgtaggggcctccctgtgcattgtaggaagttcagcaacgtgtctggccttatctgctagatgcagtagctcccccacccctggttatgacaatccaaaatatcttcagacattgttaaatgtcccatggagaacaaaatcaccctctgttgaggaccgctgccctagatcttccaggtgacccatcccaggtgacctctgcccccaacccctgacacctccttatcaaccagggtcccttgttgctagcccacccggccatgtcctccccagcagagctcatgcatggaactttccagactctacctatgcccctatgaaaaatttaatgtttccctttagtatccagcttgcagccatatggcaggaatgtattggataaataacctcttggcatagattaatatccctccaaacagggagtgacatcagggaagcttcttaacagcctatacactgttccaaagacctggcttccatcctgctcattttagactgcagagataattaaagggcagaaacattgctcagaaagccaaaaagtacaccatacgagtggccaccaactctgcctacatatacggctcccgttgatggatcatcatgacaatagtaacataaactataatgcctgtcacttagcgatcactgtggcccttttatgcatgtcatctcatgtgatccccaccccagctgtaccaggtagggcaccgacatctccttgcaccgggttacaggtgaaggaactgcgcctcagggccattcgggcacttggcagagtttacagtgcagtaagcagcagagccaggatttgagccattccagaggctcctggtcctagagcctgtcaggggagatgagcacaataatcgcatttgggttctggagcttcttgctgagctgctgtgagtggcctgggcagggaccacattgctgctatggattatagcagtggtccccaacgtttttggcaccaggaaccggtttcatggaagacaatttttctacagactggggagggggcattgcagggggatggtttcagaatgattcaagtgcattacatttattgtgcactttattattattacattttaatatataatgaaataattatataactcgtcataatgtggaatcagtgggagccctgagcttgttgttctggactagacggtcccatctgggggtgatgggagacagtgacagatcatcaggcattagagtctcataaggagcgtgcagcctagatccctggcatgcacagttcacaaggttgacactcctataagaatctaatgcccctggtgacctgacaggaggcagagctcaggcagtaatgtgagtgatggggagcagctgtaaatacagatgaagctgccttcactggctgctcacctcctgctgcgtggcctggttcctaacaggctacagacaggtaccagtccatggcccatgggttggggagtcctagattatagtatttggacccaccattccaggagctcactgtgaaataaatgggaccgaatgttcttttagaatctcctttttctatttcttcccatctagtcctttgggatcctgaaaaggtcccagacttagtgaaaaggatagacagacattaggggcaggaaaaccatcagccttagtgaatcgtatccagcacccccagggtatattatcatggcacatactaagaagatgcagatggactttttgtccatcggtgagtctgagggtattcattatgtatttggaattgtgcttggcaactggaaagtagaaggaaggccatcttgggcagtgggggaagggcagcagccaccaaagcacacagggaaatgaatgcttttggctgaagacaggagaatcttgtctggtcatcccatccattgcaatgtttgtttgtttgtttgtgacagggtctctctctgtcacccaggctggagtgtagtgttgcgatcatggctcactgcagcctctactgcccaggctcaagcgatcctcccacctcagactcctgagtagctgggactacagtcacacaccaccatgcctgactaattttttgtatttttttgtagagatgggttgccccggctggtctcaaactcctgggctcaagcaatcctcccacctcggcctcccaaagtgctgaaattataggcatgagccactgtgcccacccctgactgctattacttccagcaactcagcctcatcttttctcccatactctctgagggcctggaccacctcttatcctttgggagaaagtagcagggcatcacctggagccggttagaaatgcagaatcctggccaggcgtggtggctcacgcctgtaatcccagcactttgggaggccaaggcaggtggatcacctgaggtcagaagtttgagactagtctgaccaacatggcgaaaccctgtctctactaaaaatacaaaaatgagccaggtgtgctggtgcatgcctctaaatcccagctactcgtgagactgaggcaggagaattgcttgaacccagtatgggagggttgcagtgagccaagatcatgcatcgcactccagcctgggcaacaagagtgaaactctgtctcaaaaaaaacaaaaaaaggaaaaaaaaaaagaaatgtagaatcccggctgagcgcagtggctcatgcttgtaatcccagcactgtgggaggctgaggtgggcggatcacctgaggtcaggagttcaagactagcctgacaacatagtaaacactgactctacaaaaaatacaaaaagtaggcgtggtgatgtgcacctgtagtcccagatactcaggaggctgaggtgggaggattgctcgagcccaagagatggaggctgcagtgagccaagactgtgccactgccctccagcctggatgacagagcaagaccctgtctcaaaaaaataaataaatagaaaagaaagaaatgcagaatcccagtccccaccccagacctcctgagtcagtctgcattagaataagctcctcaggcaattctcacatgtgttgcagtttgagaatcctggaagcccaccatgcctcgtgcctaattagcagtcagtgtttgcatcatgaacggacggcctttctctctatttccattttgtgttacaggcctggtgggtaggagatgagttttttgcagatgtctggagaatatgtaccaacaacacgaattgcacagtcatcaatgacagctttcaaggtaagtgtgaatgaaggaagctgactgagaagcactgagggaggaaggaacggtcaggagtgaggcttcgggttccccgactccgtaccctctcctccactcactgcatactccggtgggcctggccgcgtttgctcagtgtgtgctggagcggaggacagcacaagctggagatgccaggggtgtggagaagccggaggctggagggagaccaactccagctaagttggacctcatgccttctcttctctgcctcttggcacagccgagtttcccgttctcatcctttctccagcttcagctctcatctagaattttctcttcccttctttttttatccaagccttgcctctaaatgggctcagagaccataatttactctccagtcacttttccctgtccagcagtaagaaatccgagatctggcggggctcagtggctcatgcctgtaatcccagcactttgggaagcagaggcggatggatcacttgaggtcaggagtttgagaccagcctggtcaatatggcgaaaccccatctctactaaaaatacaaaaattagctgggcgtggtggtgcacgcctgtaatcccagccactgaggaggctgaagcaagagaattgcttgaatccaggaggcggaggttgcggtgagccgagatcacgccactgcgctccaccctgggtgacagagtgagaccctgtctcaaaaacaaacaaaaatccaagatctggcttccgttcctagacaagctgtgtagccttgcattgggcatgtcaatttcaacatcctcagctgtagaacagaagtaataatgatgcctttgctgtgcccacctcttcaatgagctaaaatacatgaaaaggctttaaaatacagaaaatcccattcaaaaacatgctaaccactgtttttcattatgaagtgaatggttctgtttttcctcatagaactgatgaaatagatactttgggatcccagttgcctgataaaatacagtatacccggttaaattagagatttcagataaacaataagtactgttttttagtatgactatggcccaaatattaatataacatgggacatacttatgctaaaaaatatttggttttgttggtggggggggagggtttagttttttggtttttgtttgtttgtttgtttgtttttgagacagggtctcactctgtcacccaggctggagtgcagtggtgcagtcacgactcactgcagccttgacctcccgggctcaagtgatcctcccatctcagcctctcaagtagctgggactacaggcactcaccaccatgcccagctaattttcgtaatttttgtagagatggagtttcaccatgttgcccaggctggtctcgaactcctgggctccagagatctgcccacctcagcctaaaggaggaggaggagccaccatgcctctcctaaaatttatttgttgtccatcggatattcatgtactgggcatcctgtctttgtgtttgttttggtttgtttgccaaatctgacaatcctattagggagcaaaggagcctactccctgggtcccagattctcaccacactcagtaacaatatccatattcatcataaaagcagcaaaaataccagtagaaggcaccatttacttaaagtttactgtgaggcatgggtctaagtcctttacataggtgatctcatagccccatcaggcagggaccataggccccattttaagatggggaaactgaggcagagagcagttaagttacccaaggccgcatagccaggagcgaatgatggcggcaggattccagtctaggtgtgaccagctctaaagccagtacccttaaccacggaacaccatcggtgctcccttccatctcgtctgttattctgtcatgctaacctctggccctgggaacagccctccttccctgagctctgcaagccccagctgtcgccagtgtgcaaggccagctgggagggcttgctgtgctctgtggctgtttttctgaatcctccacatgggattattcacttatttttctttaaaacaggggttggcgaaccgctggccaaattcagtccaaggcctgtttttgtttggccggggagctaagaacagtttttacatttttaaaagttgtttacacacacacacacacccctaaaaacaaaacaaaaagaacattcaacaagagaccatatggttcacaaaacctaaaatattcactgtctgtccctctactgaaaaagtttgccaactttttttactttaaaaagtttacttttaaaatagcccacttttctgtacataaatctactgtatttagtggagacagggtcttgctgtgttgcccaggctggtttttcacgcctggcttcaagtgatcctcccaccttggcctcccaaagtgctggggtttttaggcatgagcctctgcactcacccataaatctattttcttttttttttttccgtttgaatcagggtctcgctttgtcactctggctggagtgcagtggtgcaatcacagctcactgtaacctctgccccccaggttcgagtgatcctcccacctcagcctccccagtagctgggattatgggtgtgtgccaccacacctggctaatttttgtattttctgtagagacagggttttaccatgttgcccatgctggtcttgaactcctgagctcaagcgattctcccacttcacccactgtggcctcccaaaccataagtctatgttaaagagaatgtcacatccctcccatgagtgttatcactcgtataaactagtatcacttgccataaaagaagggaagctttctgaaaatactagatggaaagcccaatgatgttatcaaagtctgggcagacacacttccctcctgaagcctctaagcctgtttctggtccttttcatgttaaaaaacaaacaaccccaaacacccagatattagtgggtgtttttaaagcacaaaagcagctggtggagaactcctccttgaggtccttagagaaatctatttatttatttgtttatttatttatttatttttgagacagagtctcgctctgtcacccaggctggagtgcagtggcgcaatctctgctcgctgcagtccccgccttctgggttcaagccatcctcctgcctcaaactcccaagtagctgggattacaggtgtgtgccaccacacccagctaatttttgtatttttagtagagacagggttttgccatattggccaggctggtctcaaactcctgacctcaggtgatccacctgcctctgcctcccatagtgctgggattacaggcgtgagtcaccatgcccagcccttagaggaatttaaactgagcaaagtgagcatccctctcattccgtgaatttgtgtagtttcccgtcctcactgggttccacatacacccatctcaggggctgcctggcaggcacatcctgcaccccctcccagctttgagaaaccctgttctaggaacatctattcatcctttcccccaaagccatgttttccccatttgccccatcatgggtcacttgttgctgaaaatacagattcctggtgcccactccaggacaatggtagcagaatctccagggggagaggcctaagaatctgtatttttaataagcaatcccaggtgatccctgggattgggcagatttgggaagtactgctgtaagccagagggtcaccacttgggctccatattggaattccctcggtggctttacgaagccctcgtgcccgctctcaatgcccgacgttctgatttatttcatctcagtagagcctgctgggttttctttttctttttctttttttaatggagttataatttacaaacaaggaaacgcaggcttcttaagggctcagtttggtgggttttgacaattgtataaacacccacgtaaccaccatccaaaagaagacagagaacattgccaactctccagaaagttcctcgggcccccttccacacagttgctaccgctttctgccccgagggcaaccacttctgacttctgtcactataactcacttccacctgttcctgggcctcatgggaatggggtcatgtggtgtgtgtcatagtgggggagccggtctgactcctttcgctccccataaggaattgggggaaaggctagatgctctccaagcaaccgtaatctgtagccagaatggattaaatccacagctctagacgtttcattaagtacttaccaattatgttcactccagtgagttttcaggcaaaactgcaaaattgaaggaaaaaaaagacagaaagaaaaagaaaaggaaggtgtgtccttagattttctgtgcagcgtggacgctgtcccctcacgttatcttttggcctcatcctggtggtaacattcagcattcagctcttacacaggactcccaccttgcctgcaccctccaaacccccttatgtagatgagtttactctaccttcctagcccgatgaggaaggagctattagtatccccattttagagttcaagaccaccgtgagcaacatagcgagactccatccctacaaaaattttttaaaaattagccagacatgcctgtagtcccagctacacaggaggctgaggcaggaggatcacttgggcccaagagttcaaggctgcagtgagctacggttgtgccactacactccagcctggttgtcagagtgagaccctgtctcaaaaaatatatctatatccccattttacaggtgaggaaactgaggcccacgaaggtaacccatgtgcaggatgccttccctatggccacatagctttctacacattagcctcactgtgacctgcccccatgtgacaccctccaccctaggcctcccttctccactgaaacttctctgtactgagccccaaaccttcataccccagtctctgttaaggctgacctgaaaagaaaggagctttcctcctctttgtaagtagtgaccgtgaagatcagcctccgatacctacaggctagtgtggagtccacagagcacctcacaaggtcacagtcccatgagccctgagtccatgggaatccctctctaaaatggagacccccaaggccccatcctgatttcttgagtcacaatctaccacgttggaacctgaggtttgtccttcaaaagattcccctgtccatgagccaagcatgtggggtctgtgacccagaccaggaagaatgcagagcaggtggttcttgcctcgtcttccagataaggggtcgaggattgtccagtcaaatggacactggaggtgaggggcagggggtctggaagacgccttggctgcccttgtgctcagaccatgtagacgaccgcctgaaccccttcctgtttgcctcctgtcacacctactctggagctgctgcggtcgctgtgtaccccacagtgccggctggccaaggtcctcagtcctgcgcccctgcccttttcccgcagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtaagtacatcaacgggcttccctaacaaggggctttctggaataagcactcccttcccagccgccaggagggaagccaggaggagggagaatttggaaaggagaaattggcagccgcgcggtgctgtgtgccggtgtgtgtttgcgtgtgtgtgtgtgtgtgtgtgggcgcatgcatgctgtaccacagtgggacgtttatatttgggagtttggattgagttgggagtccagggaaggcatcctggagacatgaagccagaggatctggagggtgagtaggagtcgctgtcgacagtgttgtgtctcaatagagagaggagggaacagtgtcctgggtagagggaacagcatgacggaagccctgtgacaggagggacggagagctgcccagtggggctggagtgcagtgggaagtgaaccagcagggcaggcagggccacgccccatggagtcttgcaggccatagaaaggatttggggtctttgttctaagctgatgggaagccatcaacaggtttcaagctggtgggtgacagaggtgcccacgttgcaccaggcctgtgctggctgcaggggctcaagagatgaacaaggcacagcctcagtcctggaggaacttggaggaagcagaggtctcagagcatttttttctacttaggaattttagcaaggcttaagtcagatcagaagtcagaagccacaccatgatcatttgttgtttctcagtgacgatttaaagctttctgatgacaaaatacagaagtcccttctagggtgctttccaatcaggagttgacgagtggcttgatgaaggcaagaaatctgggtgtgggagccaacttaggctgcttggccctaaccactctaactaccacctccttccagccctccacctcccgggccagggtcaagtccaaacctgccatgccctcaggatgaccctgagatgtgtcatcagtgcagtgcagtgacaacttgttctagtttgcctgggaccatcctctggtttaaaactgaaagtcccggtcaggtgcaggagcactttgggaggcccatgcaggaggactgcttgagcccaggagttcaagaccagcctgggcaacatagtgagacctcctctatacaaaaagaaaaaaaattagccaagcatggcagagcacacctgtagtcccagctacttgggaggctggagtggaagatcatttgagcctgagaggtaaaggctgcagtgagctgtggggtgctgtaccacttgtattagtccattctcaagctgctaataaagacatacccgagactgggtaatttgtaaaggaaagaggcttaatggacttacagttccacatggctggggaggcctcacagtcatggcggaagacaaaggaagaacaaaagggcttacatggcagcgggaaagagagcgtgtgcaggggaactcccatttataaaaccatcatatcttgtgagacttactcactaccacaagaacagtatgggggaaccgcccccatgattcaatgatctccacctagccccgtccttgacatgtggggattattacaattcaaggtgagattggggtggggacacagccaaaccatagcaccactgtactccagcccgagggatacagtgagactcttccttgaaaaaataataagataaatagagtagaataaaatacaatataaaataaaaacactgaaagtcccgcatcctaggaaaccccagtccagggcaaagtggggtggttggtcacactcagcgtcccctccccttggggcacttttactggacagccaggtaccaccccttctaggtacaggtggagaatgagagtgttttcaagtgcaaaagactccggagggtcacttgatcttgagaaccccccaagtccaccacagtccttccggggacctttctaaagtgcagactcccaaggccccagcctgccctcttgaatcagcatctgctgggttagagcctggggatttgtactcctgtccctgagccaagcgttggagagcaacaagccagaacaaatgaggcctaaagggagaatgcgttcttcccaaggaccctgggcgaggtagtcaggaggtgtctgatccccctcctttactgtctctgtatctgccagttagaggcgtggaccccccaccctcaccgaccccattaaaggcaattgaatcctgtcatttaacttggggtggggggacttgggtggttactctgttgcccgggctgaagtacagtggcgtgatcatggctcactgcagcctcggcctccagggctcaagcaatgctcccacctcagcctcccaaggaactgggactacagacatgtgccattatgcctggctaatttttgtagagatggggtttcactatgttgtgcaggctggtctcgcaatctgccagcgtcagcctctcaaagtgttgggattccgagcatgagccaccgcacccagcttctgaagtttattttctgttattgtctatgtttgtctgttgatctgtaagcctgcttagtcaaaattgattaccctaatatatgtatttaggaattttatatatataaattttcacatatatgaaaattcccccgtattttaatatgaaagtcacgtcttcccattttccttgcatagcatcccattctccccaactcctgtggccattttctggtccaaagacctggccctccctgttctgcttcaaactgcagagtgtttaatgctgtatcaggcagggatctttagacgcaagcagcagatactctaactcatgtgagagatgggattctgggggtagcctgcaagaatcaaaggaaaagctgaaaaaccaggtcttggaaagaagatccaggcaccagcaactgataggcagcggctccagggaggtgctgtcagaatcaaggaaccctgacagggtcactgtttagactcaggtttccaggagtgagagtctgattggcggagattgtctacgcgcttggcccctggccagagaatgtctgagcatcttgaaggatagtcccaccaaaactgcctggccaggagagagataggtcccccaaggaaaaccacagaacctaagctcatcttagctctaatgtctgtaaatattgggacagcaagtatttctttttttattttttgagatagggtttcgctctgtcgcccaagctggagtgcaggggtgcgaccttggctcgctgcaacctccgccttccgggttcaggcgattctcctgccgcagcctcccaagtagctgggactacaggtgtgcaccatcacacccagctaatttttgtgtttttagtagaggtgaggttttgctatgttggccaggctggtctcgagctcctgggtgcaagtgatctgcccgcttcaacctcccaaagtggtgggattacaggcatgatccaacgcacccagccaaggaccacaagtactaaaattagggtgcttttggccttatgtgagagaaaatcgaattaactgtgatttcagccacaaagatagttactatttttacataacaagtactctggaggtagaaaagtttctagagctgatttagcagcgtctgcgtcaagcacttccgctcattccatccttctattctgtcatctttagtgttggtgttgacctcttcgtggctccaaaaagtttgctgcaactccagatatttcatcctgccccgacaatatttaaagcagtcagcaagagaaaggagagcaatttaaaaaagctttctcctccctcatcgctctcttttcaggcagtcatatttttctttttttttttgagaggaagtttttgctgttgtgcgggctggagtgcagtggtgcgatctcggctcactgcaacctctgcctcgtgagttaaagcgattctcctgcctcagcctccctagtagctgggattacaggcacctaccaccacacccggctaattttttgtatttttagtagggacggggtttcaccatgttggccaggctggtctggaactactgacctcaggtgacccacctaccttggcctcacaaagtgctgggattacaggcatgagtcaccgtgtccggcccagggagtcatatttttcactgaaggttttctgtggtcagaactgggatacatactgacccatcagctataacaagtaaacaggaaccagattgccaagaagaaggttggcaaactatggcccataggtcaaatctggcctgccacatgtttttgtaaataaaatcttattgtaacactgccactattattcatttttgtattgtctataggtggtgtcatgctactgtggcagacttgtgtgaccatggcccacagaaaacctaaactgcttactgtctggccctttacagggtacgtctgtggacctctggcttagaccaattatgttcaccctctgggttggtgatgtggctgcccaaacaaaactgggtttagttagcaagaatgggaagcaaaatagctacagggtaggtgacaatatccttccacaaaatatcagttgtaatttttccaatagactaaaataaatacctattaataataagagcttaaggctgcacgcggtggctcacgtctgtaatcccagcactttgggaggccgaggcaggaggattgcttgagctcaggagttcaagaccagcctgggtgacatggcaaaatcttgtctctacaacaaaataataataaacaaagaataaaagctgaagtttgtcttcaactctggccgtatgcccctgggctacccagggtgcactgtggtccatgatttattgaaaattcacctttcttcctgacaggtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagcccaaaaaaaaaaaaaaaaaaaaaaaaaaagaaaaacgaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttcttttttttttttttttttgagactgagttttgctcttgttgcccaggctggagtgcagtggcaccatcttggctcaccgcaacctctgcctcctgggttcaagtgattctcctgcctcagcctcccgagtagctgggattacaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactgctgtacaacattcagtgcccacatccacctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctanggcagaatgctgccattttgaggggcagggggtcagctgatttctcatcaagataataatgtatggtttttacactaagcaactgataaatggacaatttatcactggacaa

SEQ ID NO: 13984 - DNA, 277 bp, Homo sapiens
ttttaaattattttatatgtatttcttgtagagacagagtctcgctgtgttgcctacactggtctagaactcctggcctcaagcgatcctcctgcctcggcctgccaaactgctggaattgcaggtgtgagccactcactgtgtccggcataaagtagaacattcttacaagaaataaatatttcgtagtcatggagaagaacgctcctaaaatgtatgtatccgttcattcatccatccattcattcattcttttatggggcggggggtctgttgc

SEQ ID NO: 13985 - DNA, 395 bp, Homo sapiens
gaaatgagttaagactttggggactgtgggaagggcattgttgtgttttgaaatgtgaggacatgaaatttgggagggaccaggggcaaaatgatatggtttggctgtttccccacccaaatctcatcttgaattgtagttcttatagtccccatgtgtcatggaagggacctggtgggaggtaattgtaggtggtttaccccatgctattcttgtgacagtaagttctcataagatctgatggttttataaggggcttcccactttactcagttctcattcttctccttcctatcaccatgtgaagatggacatgtttgctttcccttctgccatgattgtaaatttcctgaggcctccccagccctgcagaactgtgagtcaattaaagctgt

SEQ ID NO: 13986 - DNA, 395 bp, Homo sapiens; identical to SEQ ID NO: 13985

SEQ ID NO: 13987 - DNA, 2111 bp, Homo sapiens
gagagggatttgtgcatgcctgtgacacctttctcttcattcttctgtgcctctatgattgttacaccttttttattttttttcttttttgagacagaattgctctctgttgcccaggctggagtgcagtggtacgatctcggctcactgcaacctctgcctcccaggttcaagcgattctcccgcctcagcctcctgagtagctgggattacaggcacatcccaccacgcctggctaatattccttttttcgtttttgagacaagattttgtcatgttgcccaggctggtctcaaacccctaggctcaagcaattcacttacctcagcctcccaaaatgctgggattacaggcatgagctaccgcatccggcctccatttattatttaagtattggtgtttttctgggtctggatctcgccttgaccctcattagtcttcctttccttcggcaaacccttgtggtgtcaaagatgatgatgacttccagatccctggcaccagcacacacctctcttctgtgctccatgtttcaaatgcctgctgatcatctctcccacatgtctcacatggacctcaaacttaacttacgcctaaggtaaacttgttaaagcctattttaaaacaagtcttaatcttcattaaggcttctccacacacttattcacccaaattcgaaatctgagagctgttttcaacctccccctgttcctgttcctgacttcaacattccattgattagtaagttctgtcaattctacctttaaacatcaaagtctgttctcatcatccctactgacactgccttagtttgagtttctccatttgtaatttaagccagaaattctcaaactttagcttgcacaaacatcacctggagagcttgttaagacaccagagattctgagtctgtgcttctggggtggggcctgagagtgcatttccaacaagaccccaggtaatgctgatgtttgggtccatggaccacaggtttcgcacttcaatttattctaattgcttcttacctgtcctcctgctttggcttcacaagctccaatgtggttaatgaagttatcgttccaaaacaatttttactgtgtggcttttctgcttatgtattttataggactctgcattgcctgcaacacaaagcccagatacctttcctggcatgcaaggcctttggcagtctgactccagcttagttttccaatctcatctcttgccacttctccctgtaccttaagtaatttaaattatggccaggagtggtgcctcatgcctgtaatcccagtactttgtgagaccgaggcaggcagatcacgaggtcaggagttcgagaccagcctgaccaacatgacgaaaccccgtctctactaaaaatacaaaacttagccaggcatggtggcatgtgcctgtaatcccagctactcaggaagctgaggcaggagaattgcttgaacccgggaggtagaggttgcagtaagctgagattgcaccattgtactccagcctgggcaacagagcgagactccatctcaaaaaaaaaaaaaatatatatatatatatatatatagatagatagatagatagatagatagatagatctgtgcttccttgttcccatgttttgtacatgctatttctcgcatctgcaatgtccattctcttcttccattccccaccttttcctcactcccaaatggataactcacacttgctctttaagattcaacttacatattattttctttgtgctccagtagctctttgcatttctcttataggaattaccatgttgtgtcttgtctgtctgttagtttctctcataagaatgtaagttcatcaaaggaatggactgtgtctcattttagctttgtttctgagcccaaagctagaattgtgtttgtttagcacaatgcttggccacagcaagcatctatgatgttgtttaaactgactttaatcctataaatcaatgtctcccctcaaatgtgtcccactagtaccaggagatttttcaggaaaatgtcctatagtctaataatttggcaaatcacaaattctatgtaatagtgtatataggctctagaaagactagcaaaaaaaaa

SEQ ID NO: 13988 - DNA, 445 bp, Homo sapiens
ctctaatgagactatattagactctgaacttacagtttccccgaaagaggttgccctaagtatagggatacagaggaaggggcatgggttgctgagacaagtgtcctgagtttgagtcccagctctgctgcttactgactccatagccactataagtttactctgagcctcagtttcctcattgtgaaatgcagcaataatttcctcaccaagacaccgtgaggattgcacaaagtaatagcaaagtcatatactcaacaaatatttattctattcctattgtgtgtcaggccatattttcagtgctgggctacattcattgacaggacagacaaaaatatctacccttatggagttgggaatggttggagagaaagacaataaacaagataaataagtaaaatatagagagtgttaaatgacgttaagcgctatggaaaaagac

SEQ ID NO: 13989 - DNA, 12079 bp, Homo sapiens
agccccattgacaaaccttcagattctctcagtatagggaacggtgataattcccagcaggtaagatttgaatacagtatcacttgatttatttgccatactccgaaagcaaggtattccatgcaggtgaattttctaaaaatactttactgacacaatttaaaaacacttttgatgctcatctttattaatcatattataattagccttttccccccagaatatatagagcatagtttaacccttttttaatgactcagaattatcattatgaccagatactattatctttagagtctgctaatgttattggtctttttgaccctgtgccaaatggtcccaggctagcatgccttctgagttccttgcttttaagaattgtattcctaccacatactccccttgccccttgctctctactttaattttctatttcagtcaagtgtatttgtccctaacagtttcccttcttattttccccaaatgactatcagctttgaaatgataagccagataaactgttcaaagttgaatttactatgaaactgagtggagtgctgaccgttagagcatgctttatgtcatcttgtcttattgctcagggaacttttttttttttttggctagtttttcactccttgagtttctatacatcttcttacattggtaaaataaatgtaatttagtatctcccgtaaagaatagccagtcctccacagtatttatgaaaaacttagagatctaaaatataatgcttttctaaacgttttaatgacacattttgtaaaagaatgtggaaatctgtatatccccttgtgtattttagttgcccattaacattttttacaggttaaaagtagttgcaaaggatgtaatttccagcatattagaaatattggtatctgaaaaatttaatgttttgatatcccatcataatgttttgatcataattctgttttattatcctgtcatccatttaaaaaaatacacatgctctcctttaacaatcagaagttttacattatttttttctctgtgaactaatttttctctttctgttattatagagttttatcttaatgcaatatagtttttgcttgaaaagcatatacttctcttaaaaataggcatataaatttttggattgaaataatgtttttgcggtcacagacttcaaatgccaatttttgtcttctgaattttattagtagtattgaggtgacactatacataaatgtagattttaattttaaaaaccatgaaacaaatagtaataaatggtaaaattatagtaaaataaatagtaaaattatattgaaaattcatctcttaatgaagaatagggccattttaaaattggtttgtatgtatctctagattaatgttacctattggtaaaagagccaagtttcagcagcaatctagtcgtgttttttatttttctaagatgtaagtgttgagataagatactttgttcatataaataggtagatggaaggaggagtattatatcagtaccactcaagtctttcaatttcttctgaattaaatacctaagaatcatacaaagatttattatacaaaattatttttaatgatgtgtttggaaacaacttaattagatctttctttaataatctagccattacagtcagtttctctcttatcaccaatccatgtatttctaataatttgtgtttggcctctggaaagttttcactcttgagcaaaatactgtagtaaaatcccagaatgagaaatattattttcttggtaaagtgagagaagtaaagttgtaaaaagagaggagatggccgggcacggtggctcatgcctgtaattccagcactttgggaggccgaggcgggtggatcacgaggtcaggagatcgagaccatcctggataatgcggtgaaaccccgtctctactaaaaatacaaaaaattagccgggcgtggtggcacgcgcctgtagtcccagctacttgggaggctgaggcaggagaattgcttgaaccccggaggccgaggttgcagtgagccgagatcaagccactgcactccagcctgggcaacagagtgagactccatctcaaaaaaaaaaaaaaaaaaaaaaaaaaaagggagactagtttaatcttttcaagcagattaatatttttttaaagagtatatatgtaagttaatgatttaattgattttctgaaacttcatgctttcattaaaacatcttcaagtaccagtttgtgaaacactattctaatacatttagttgcaaactttttaattgtggcttattaaaatgtataaacatgtagttattatttgttttccttttttattcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcaggtatataacaatagtaccaagtattagtaattatgctcttaacgtattgttgacagactaacatgaaactcattagtggatatatttttatcttttgcctctctgttctcttttaataaaaatgcaaatatttaaactacatggaattaggtggttaaatacattgttgtgtgacctagaaattactgtgttaaaagatttctccagaagtaaagggttatattgttttcccaatagtaaaaagcttattccattgggaattttttttttcatttttactttttggaggtgggggtcttggtctctcgcccaggctggagtgcaagtagtgtgatcttagctcactgcagcctcacaccctgggttcaagtgatcctcccacctcagcctcctggttaatttttaaattttttgtagagacagggtcttgctatactgcccaggtcttgaactcctggcctcaagtgatcctcccacccaagccttccaaagtgctgggattacaggcatgaagcactgcacctggcaaggacttagatttttaattagatttgtatttttatttaattagatttgtgtttaagattttccacccccagctgacaaagatgcaagttatttagtagtaacagttatgttactactaaatggtatttttgagccatttccatttttatccattctaaattctctcattactatgaaaggtggcataaaagtaacattgacaacagcacctgtggagcagaaaattccaaaaaactatgaggattaatataaatactttttaattaaattatatttttcttagtatagaaagcatgtattcaaaattatttgtactttgataaatacatttaaaaatcaactttactaattaaaatctgttatatttatttgatggaagtgacttaggttggttttgattatgaatggttgagagtataattggagtgtcaagtacatttttttcctttgattagcaaaatcagtctatatcattcagtttttgaagctagtagcttaagagttaagtaactgctagaagtacataaggccttttgtaattatatgatcttaatgtgctaagaagtcacatagattttgcacttacttaatttgtaaaatgacatgtttaactttcagtagcatggatacttattaagtatgaaaatgagctatgtatctgatattcatcactatttttcttcccaacagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtaggttcatttaaaacctttgagaatttttgaataactcatattttcaggttgttgggtggatagggaagtaactgttgaataacagagtactaatatcttggaaatgtctatgaaagattagtctttatcataatctaaaatatatttttcattagatggatgccttgtaatattgagctttataaggatggtggagtattatacttagttattgtttggaagcattttacttaataggataattaccaaactttcatatggtatacaaatgcaaaatgaaaaagaagaaaatggtctctgaagttatggtactataaagtccaacaccgtggtgaaaattatgattttatattctaaagtaaaatggttaaaaaaaatttttttaatgataattaatgagagcatgagggataaagccactctctacctacttttggcagttacttgttttgactgatacacatatacacacacatcaaaactgagctataaatatacttgagaactctgattatgaatgttttacaagcatatcatatgtctcagacatacaccttttgtgaaagagaaattgttcaaggaaagatactttcccatttgatctgccatgtttttatttctggggaaaaatatgaagtatatataaggtaatgtaagtttgatgccaaaatacttctggttttgtactgctacccttgaaggtttcagaacttttgggttttaagattctatataacattttttagatgaagtatcttctatatccaagggaattattcttgttaatagtgttctcgtttaactttggctttagagatgatgttaaaaaaagtttgttcctctcctgattctctcaagtgaaatagaatcatgattctctcaagtagaatacaatagtttctcactctgttagaatagttcttcacataattcatacaatttattgttatcccttgttagatatggcatggcacagtattattgtaataggatacttttatcagcagcaaggcagaagttcacgctcttgtttttagcaaggctgatagatgaatttacagaggtctatcaaagttctttatccctgttccctttgggaccgacaatatttcatgttttagacgagtagctaggttaagagaatatagtttgtggctgttgacatagtgaaatttaccgttgatacagtgaagttaatttacataagcctggtagcacgtaatgtagttatttgcacagtgttgggactcttatttgttcatttaattatggtagttagtaggtaaccagagtgacatttttcagtcctcttcttctacatgatacttacttgtgaaacaatgtgttcagttccaaatactccttttatttccttccattcaagatagcatattagaatgtaattttctttgattttactttgctttaatcattgagaaatgtggcattttaattactagtagtgtatctcataattgattataacattcattaaaagttaaagttaagttctcccaaatcatcaaaacatttaaagattagaccaattacagtgaatatgagggtttctatttgcccatcaatgaattaggacatgtgggacatattaaagaagtttaagatatggataaaatttccacatacttaaagtatagttgaagagactaaaataatgtgtgaaagtggtaactatatgtctgatactggaatctgagagacatcaatgtaccctgtaattcttggggaggcttcattgaataagtaggaattgatccctactatcatatcttagatttgggttagcagcaggggaagagaaaaggccttttatgttgatggaaacctcctgagtaaaggcatagaggcaggaattagtatgtcattacactgagaagtaatacagctacctcctataacaggaggtgcttcttaaattgtatagatataatggatgagaagatgagaaactctgacaatgaggcaaaatggcatggacttggtatgataggaagtaggatgcctttatgggattctagttattagctgtcttctttttgtgcttttatttgacttattacatgacgatctttgattttcttccaatttcatagtcatcatattatcccttaacactgaagagtagttttaacccatatatttcaaaccaatagttattctcagaatgctgcactggtaatgagaaatcgctgattagtgagtttagttgtccttgtgttagtcatttaaaatcttcgtctaaagtagatgctttatggaaaaaatgtgacattaaattatggtcctatctttggggattttgttttaatttttaaaacttttaccatatactcaaccatagagcattaaaacctttttttttcagagatgctaaaaatgtagtcaccaactttaggttctgaatcgttgtactatttggtagggggtgggagagtttattttggattttcaatttcaggctatgcagacttgcttggtatttaaatggtgacttatggttaagcttattattaggttatttttaaggctctgatgactagagaaattttagttttaatgtaccaaaatttaaaaatttttatcaagagtctcacacaccagaatcctctcatggattataaatatttggtagatgccccagaaaactgaatgtgctaagcctcagagcagaatagctgtgtaattgtagccagaagatttaggattttcagtaactattagaaatgacagaaagtgaaaatctggaaaactatatatacatcttaactatgtctaatttgaagcaatttaatacctaggtaactcacttgcacctgttgtaactcacttgcacctgttctaactcacttgcacctgagttgaactattggcaaggattcaactttgtatcttttagcagttatcatgataccttacacagggcagctgtcactaaatgcttcagtaatggagagagtacatacctgtttcagtgggacctgctactttaagatatacttagacaatattttaaactaattctacactctggaaaggcatatatatttattctctaaatatgtagagcaaaatatggtctctgacctgtaagagcaaatcagagatggcagtcacctacatgtcatacagatagaatgtctacttactatacatttgtacttaaatttttatttttggtttgttcagtgaattattaaagattgatatatctgaaacctatcatgggaaaaacagttgccagaggtttgacagaaatgcagcttcctttttttttgatctaattgaaaactgtttttgtgtttaaaattagtagttatttccttaattaggtgaaacctttttagcagcatttggtttactaagtttagaaatatttttgacataaatattcttgggggaaattttgattcgtgggcagttacagtaaattcattcagatctttttttttattattattggaaccatatgccttctttctacaaagtgatttaccttgtcctaaaacgtgactttgttttgtccaattccttcattttaggaatagcaaagctgtgttccagaaagcttaaataatttgttaaaggtcacatattcaattagtagtggaattagggtaagaacttagatctcaaattcaacaatggaaatgtttttgcactacaacgatgccctccttcataaatgaagatcactggcatgtgctttaacttggctttcttcccgtggcaattgtttttgctctcacacacttggaagtccctttttatcaacagtatcaactcatgagacaaattggcccagctcaggggtatatggcctattgttacaaaatagaataaagtgtatcgacttgatagaaatcagtctgtttcttagtccttattaatatcattttcttgctaagaactctagtctaaaatttgctttacagagcctcattgctatgttcttggggtttataagaatctttgccaatttactgaaaaactacaaaatcacctgttatatggattgacagactctttttctgctttgtcagttatccttccacatgtaattttgcagatttgttttaaaaaaatattctgccaagttgtttttattccatgatgttaaaaattatttggaaaacataagtcagtaagcattgttgtttcaagatatacctcaaaaaatatttgaaactgtttaggattggatttttttttcatgtttttgttaatttaaactttacttttgagagggcatttttctttaaattttctttgtttctatatgaactgttttaacagtgacttgattgaattttgagtcatgtgtgaaacaagtcacttgtagtcaaataattttcagttataatcaggagaaccgatctcattcatctataattctctgacctagaagtagtcatctcattttcagtcaattggatcattgtactgttaacattttactatttttcaattacttcaaaggtaaacttgaattttcagatgctgtatgttaatttactagttaatatttatagctttcatttttttctagtacataatttatgctttcaaaacatggatttgtaatttttctcttttaaaaatcagttttcacttctgtaaatcaaggtttaattttttcacaaaatactattaatatttaccatttactaggagtatctataagggtccaattggcttggaaaagaatggctttcctggtctttttttttttttttttttttggtagtatgtttataatctaaatctattgtatttgttcttatctctgaaacaatattactcaggatatatttagaatataactactttccaagtacttgataagtttatattttaaaattcatgtcttgtttcacacctggattccaaacattaagcatgtattttatatatgtatcagtattccaaatattgaaatcatttttaaagggactgttaacaaatctagtcacccataactagaccatgactgacttttccacaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccatcaaaaaaaaaaaaaaaaagaac

SEQ ID NO: 13990 - DNA, 455 bp, Homo sapiens
aatttttttcctataacacagtatcagaacaatacatttgagtaacgatagtcatgtaccacatatcaatgttttgttttggtcaacaatggctggaccacatatacaatggtggttctatataattagaaataacttttttactgtaccttttctatttttagatatatttagatacacaaatgcttacccttatgttacattgcctacagtattcaaaacagtaacatgctgtacaggtttgcagcgtaggagcactaggcactatatagcctcagtgtgtagtaaaccatgccatctaggtttatgtgagtgcacactttaatgtttccacaatgacaaaatcacctatcaatgcatgtctcaaaatgtatcccatcattaagcaacccatgactatttttgttcatgtgctgagttaaataaagttagttataggaatgatatcagtacac

SEQ ID NO: 13991 - DNA, 530 bp, Homo sapiens
atgctttccttttcattctattattgaattttggttttccatgtgttacttttgtgtactctccccttatttcaacaaagcattaattaaatatttgagtacctattctgtatagtgacttgaactagatctttagagatacaaggttgaataaaatacagaccctatcatcaaggataattctagtgacaattatatttcacattatttctgtcaggtcttgataatattttaatcacaggaaccaccatagcagtccagactcattttattatttatcatctctcagtaactgctccgacagtggcaacaaagggtattgaatacttatatttcaaattttaaaatttatgataatttggagggaggtgaaaaaaccttactaggaaagacaaacattcattattctacgtgtgtgtgagctcatgtctcttactcttagcatcctgggaattaagtacagccttctgtgtaggtgttcctttaaagaaaacaactttaatgcattttacctctgcacatttccactg

SEQ ID NO: 13992 - DNA, 24770 bp, Homo sapiens
atatttgaagtacagtttgctgttttcttcttaggtttatcggcgggggcttcaggcaatacctcttagtgttgacctttggatacattatataaacttcttaaaagaaacattggaccctggtgatcctgagacaaacaatacaataagagggtatgtggaacattgatactgaaatgttttttatgatataaataattattctgatgttgataatagagctcatgaaagctaagctggaagtttaacttctattccattgttaaaaaaatgatacatgtaataaacttaagctttatgatttgaaaatgcagataataaagccctcctacagtccatgcctcttatgtccccaattccactcctcaaggttaatagcttggtgtgtgttctttcagatatatgtataagtacatgtttatgcgtatgctttcatactgctctttgactttttttttttaataatgtttgggaatctcttcctgccatattttttaacaattacaaaaagtattttataatactttataaaaagtatcttataagccaaagtactctatttcaccaaatccttatttataggaaataatcagtgctacagtgaacatctctgtacaagtcaatattttttgtagaatgcactagaaatggaacttctgtcaaagggaacacacagctcagttttatcaaatgttccttcaaaaatggtatcgattctaaactcccacagtgtatgaaaataatcattttcccacagctgtgccacattttttgtttgttttacctccagtggcatctcttttaatttgtttatgtcttgattgctcatcctggtttaccatgttctcatatgcttatataagccattttttaaattacctgttgatattatttgctcatttttctattacattatctttttcttgattacagtagtttgctaatgtacttgtttttggttttcaaaaaaaagcatgtgcatattgcttaagaagttagctaatgttaaactgcttgtaacaaaaagtaccacctccacctcccttcaaatattttagctctttcttctggtattttccaccatgtgtttaacagtagatctatgttgctttctttctttctctgttagctgtagacattatgtatctgttacggtaagtgagaattttaacccacttacactttgttttctcattccttatctttccaatatagctacagaataggtttcaataatcagcttcagtatttttttttaatcattgtaaatccataaataaggatgggcacagtggcttatacctgtaatcccagcactttgggaggctgaagtgggaggagcgcttgagcctgggaggttgaggctgcagtgagctgtgattgcaccactgcactctagcctgagtgacagagtgagaccttgtctcaaaaacaaaaaacattagctgggcatggtggcgcatgcctgtagttctagctactcgggaggctgaggcaagagaatcgcttgaacctgggaggtggaggttgcagtgagccaagatcgatcgtgccactgcactccagcctggatgacagagcaagaccctgtctcaaaaaaaaaaaaaaaagagagagagatcaaaaacctataaatatttttcatcatactgtcttttcattttataacctttttggtttttaattgctcctcccctgcccctcatttttcccgtttgtctaattttctttgaacatttaaggttttttcatactctccagcagctttgtagaaggctttaaatatagctttctatacaatcagatctgttaaaaaatgtgtaagtcccattttttcctctcctttgagctgtctcctggaaaccttcctactataatctggactggtcttctagttctgctgtacaagagttgtcttgggattttcttatcatcatggttctaggagatgtctttacctcacttctgggtgagtttattattagatctcactcttttcttgatttcatgtccaacttttagaagagtgtgtcctataacttcttgttaaaggatgcttggatgaaaaaataattttaaggtttggtaagctgtagaatttggagttgaaaattattttctccatagagctttgaaggcattatttattcctttatagcttctgctattgcttttgagaagtccaataccattcttgcagaatagattctctttctataatgtgtttttcctctgtggaagctgttaggatgttctctttgggtctgatgtaaatgaagttttataaaaatgagctttgatgtggattttctttttcttattgtgattattgggtgattgggtgagtcttttcattctgagattctaatgtccttctattcttagaaatgttattattatggatattcttattttgacagtttccttgccttgattttctctgttgtttttaatagttggatgttggacctcttcttttaattactgagtttttcttttcttcttcctatttttcatatcttagactttgtctggctttttgaggtatttccttgacccttgtattggatttttaacatcttccatcagattattattatttttttttttgagacagagtctccctctctcccccagggtggagtgcagtggctcgatctcggctcactgcaagctccacctcctgggttcacgccattcttctgcaccagcctcctgagtagctgggactacaggcacctgccaccacgcctgactaattttttgtatttttagtagagacagggtttcaccgtgttagccaggatgatctgcatctcctgacctcgtgatccgcccgtcttggcctcccaaagtgctgggattacaggcgtgagccaccacgcccggcccagattcttaatatccaagaatctttcttgttctctgagtgttcctttttttatactctccaattcttgtttcatggctgcatatctttttgttatttctttgatgatactaaggatagttgagattttcctctgttcccaggacggtttcctctcaaatttttctgtttacccattttcatctctgagatatgtgatctctggatttttgttcctattacagattagatattaacaagctatatgagccaggcacagtggatcacttgaggtcaggagttcgagaccagtctggccaacatggtgaaaccctgtctctacttaaaatacaaaaaaattagctgggcatgctggcaggagtctgtaatcccagcttctcaggaggctgaggtaggagaattgcttgaacctggaaggcagaagttgcagttagctgagatcgtgacattgcactccagcctgggtgacagagcgagaccctgtctcaaaaacaaacaaacaaacaaacaaacaaacaaaacaaaacacaagcatatggaagcactgtgtgttttgtatggggcattgtcagttggcctatggtgtttcacagtagtgtaatcatgtggccactctttttgctggtggattcccagtgatagtaaccttatatcttattcctgagccaagcagtttgtttagaaaaggataattttatttacttggggaatggacacctagcttctgaaatccccatagctgggcgggaaagttgaagatttctcacgattcattaagtataccttcttctaaacgttctgtcttcatttcattaccttcttgtcttcttccccttttctccatacttttttcagtgtctggttaattttctgaatcatttggggttctgtagggacagtaacatctattttattcttttgaaaaccttacaccaaatatgcacatgcatgcatgcacagacacacatgctcttcaatcttttatttctatattaaacatatttcctccaatgttggtatgtttttaactttgtttatggtgtcttttatcatatggagttttatttttccttaatgtgcttctgttttaattcttactggttcctgagttttgtgcctattttaccaaaaatatataaatcctgtattttgttctaacttttctatagttttttgcttattcatttatctgaatttaatttctatctgtcgtgagatagacattagccttttatatactcccactgttgaattaaagtatctcctatatcatacaccaaatactcacacacattgatctcttttttgttttcttggctctgtactgttcatccatttttctgttacctggccagtgccaaacgtgtaattactatagcttcctagtttcttatattatctttcaggaaaatgcctgctgcattatccttttacaaagtcattttgcatttttgtattctagatgaatagtagaatttgattttttcttgttccactaaacattttttagcgctttattgaaattgtgttaaaattgtggtttaacttaggggagtgtagttttatactttttaaaaatctctcttgattctaagatacttatcttgaaagtatgtatctaaaagctttatcccattggagtattaaatccagtgattaaaattgcttacagaaatctcttgacatgactaggtattttaaaatactttgtaacaaactttttttttttctttggagacagagtcttgctctgtcatccaggctggagtgcagtgttgagtggtgcaatttcagctcactgccactttcgcctcccaggttcaagtgattctcatgcctcaaactcccgagtagctcggattacagatgtgcaccacaacgcctggctaatttttgtatttttagtagagatggggtttcgccgtgttggcaaggctggtctcaaactcctggcctcatgtgctggaattacaggtgtgagccatcgtgcccagcctgtgataaaactttaatgatagaattttagaattgagaggggcttttgagaggtttaaagtatatgtatactttttttttttttttgagacagagtcgcgctctgtcgcccagtctggagtgcagtggtgcaatcttggctcattgcaacctccgcctgccgggttcaagcaattctcctgcctcagcctcccaagtagctgggactacaggcatgtgccaccatgcctggctaattttttgtatttttgtagagatggggtttcaccatgttggccatgttgatcttgaactcctgacctaaggtgatcctcccgcctcagcctccctaagtgctgcgattacaggcatgagcctgtaatcacgcctgtaaccatttcaccatgcctcatgaaaatattcttaaattgagataaaatttgcctctctttaacttcctacttgttttaattttgtcttctgtcataaatcaatctatacaatagacatttcagatttaacaaatacttacatgtctactcttacctatttgcaatgtgtacattttgtatttaattttctatttgataaagttacataaaaagtacatttatctattctctttgttttctcactctttttaagcagctgttgtatgctttctgttattctgtctaccctttaatccctacttgcataggaagcagttgaatataatttttgaagttagcattatcttctaaatttagaaataatattttaaaagtgattttatcttggaaagataacttaagagtaatttaatttttcagaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagaggtaggtgggaaattctgatcattgaaacatctttgattactcagatagttggtaatattaagtattataattatcttggaatgttatgtaagcttttattatgtggaaagaggaataaattttgttgctaatcacaacctacatgcttgcttttgacattttttcatatgccttatgaaatgtttagaaattttactgtttttagatagaagtttctccttattcattttaatggataaagagaaacaggaattctgtcttgtctaaggtagttcagagtaatgaaggaatgagaaaatagtacctaagttgagttatttatttatggcattaaattgacacagtgcctggcacatgatagatgcttattttttttgaaacttaatgatttgctaaatatacattattgtgattgctataacaccttatatccaaaacagtgaaggatgcattttatatagtaagtagtatctattttcaaacactcaggtatcattccattttaattttctaaaatgatttttctgttacaattggtatccttttattttaatgattactgttaaaacaactaattctgtgtcattatttttgtgttctgttttctgctttattcagagtatcccataaataaggatccagaaagtctttctgaacgagtatgaggactgtgtctttgcttttaaattggcatgttttctattttttgttataatttttatgagtagtattgtataaacttagtattttctattttttgttataatttttatgagtagtattgtataaacttaggtactttttaagtgagtgattttctaaattttttttttagtaccaaaagtagaagacttttatgaagcatttgtaaagtactaaggatcaatgtgctaaaggtagaagttatacagactcaggttagaaataggaagcatatagataggaatattctctctgctcttgatgaaatagaggaagcaggcaggtttctaaggtataacgacctaggaagacacttgctgaaagatgttaacacaagtaagaattggcatatggaaatgcttggtaaatagttaccaaacacataagtacaaaagtacttaaattacctgatgggccaaagagggtgtcttttcatagactagttcttctgtgatttaaagtataggaaaaatctatgactacaagaactttactgatgatggaaaaaaaatatttgtaggaaacacacatagcattttctatatcccagacactgtgctgagtgctttgtaactcacttaatcctcccagtaacccagtgaggcaagtactattgttcccattttatgaaaggggagacacagggagattagcatatttatctaaggccacagagtttgtaagtgattggaagctacttggaacttagacagtatggccctgaagtttttgatatgttctcctacaaatcttttttatttctaaataaatatcccactaggcttttatttatttatttttctttaagttgtcagttaccctaggcttttaaaaatgcatatatacttacaatagatattagtgggattatattacacatactgatctataatctgatatttttcacttaatgcatttagaaccactttccttatcagttatagtgaactcacaagtaatctttatgcagttcttatagtttatataagttaattcacatgactaactgctttgagaaccactgaatgttttgttttttttttccataacacatgcctctttcttaaagtcatttatttagcatttgctgtgtacctgttgataggctatttaagttgtaggaatgaaggcccaaagaagccatgtgtaaatagcgttgcctgtgagttggtcagaaggatagaggaggaggcgtgtgttaaaaaagatattctaagtggtatacagtaataatggaaatatttttattgtgcttgtgcattaggcttgtaccattggatgtaccctgcacattatctctgagataatgtctaatttaaatccttctttagcatgaggactttgtgatctggtctaacatccaggtccaatccctggtggttcctgagctctagacacacctaagtctgataacttcccaaagggcagtgttgttttatatctttatgactgtaataccttttcctctttccacttgtctagtggacttatattccctgagaccacacagttttgtgtcttctctgtgaaattttctctggttctcctatactgagatacctagtctgttatttgtgccatgactttacctacatttatttacatttatattagcaccagtaacactgctttgaatttatgtctcttatatcctcaacatgcctgtcagtttctgaggcttaattctttgtatctctaatatttaggaatagagctcaatatatattaggcagtcagccagtctttactgaataaatgttagctttataatacaaaaaactgctgaaaaaatactgcttaatattatgcacattttgtcactgttttaaagaagttgttacatgatgtagcaataagtcattttagatttatgtactgtatgtagttattttgaaattttaccttaagtttttaattcatttgttgaccattctgagttttaatattcatctgtaattaaatctgttttttcatactacatatttgagagttacttccttatttttaattttttaacataaggcaatctttgttaatttttttccacctggtgctgaaatgggccgttagcctctgtatccattgactttgcaaaatttaaattagattccaatgttatttatatactttttttttttttttttttgaggtgaaatctcgctctgttgcccaggctggattgcagtggtgcagtcttggctcactgcagcctccacctcccaggttcaagtgattctcctgcctcagcctcccgagtagctgggattacaggtgcccgccccgacacggagctaatttttgtatttttggtacagatgggtttcagcgtgtttgccaggctggtctcaaactcctgacctcaggtgatccgcccacctcagcctcccaaagtgctgggattacaggcgtcagcaggcgcctgacctgtttgcttactttttagtaacatttctgatagtagtatagaggtgggaatgggagttgtgagactagaggctgcaaggtcattttatgtttatccagcttaaaagtcccgaggtgatgaacatgtatttaaaaggtacagtcagtaggacctggtatctaatgtaaatgaaaagctaggtggaagagattgagagatgtagtggttgacagtaccattaatcaatattagaaatgctgagggtggcggggcacggtggctcacacctgtaatcccagcactttgggaggctgaggcgggtggatcacctgaggtcaggagttcgagaccaggctgccaacaaggtgaaaccccgtctctactaaaattagaaaaattagctgggcgtggtggtgcgcacctgtaatcccagctacttgggaggctgaggcaggagaattgcttgaacccgggaggtggagcttgcagtgagccaagatagaacgattgcactctagcctgggcaacagagcaggactccatctcacacaagaaaataaagaaagaaatactgagggtattcattttcagatgaagatgccatacttattttaaaatatttcatatttgaggttccaaaggtatattcaaattgtgatagtgtagatattttagctcctcaacctggtatttttgattacaatttgtatgtatacaaattattgcatgtttttataaaatagtgaaatgatatttttttcaaaaatctttttatagattagcttaaaactaatccacatttctttgtgcagagtattggcagttgtatatgctaatgtgattaggagaaaggtttggacttgtgttgtagttttgagagtcatcatggtatacttatttcaagctgtatgaatgagattggccagaagtatgtattaataaaaatagatgagaaccaaatggagagtggaatacttgggtatagtagcatttagggcaggtaagaaggggaataagacatagagcagcagtcagaggcttggaggaccatactacaaaacaagtgtccatttaattttatatatgaggtaattgataatcttaattgggcagtttcattggatttttgcgtactcacatgtggatgaggagtatttgggaggtgggaaggaaatgctatatttgttggttatttacaagtgatcatttagaatttaaatatggattacagtatttaattttactgtaacttttatgtctttgtagtaaaatagattctatgacacacgaataggtattatcatcttattttacaattgaggaaactaagatttagagaaaagaaaaccttccctagtcagataaccagtaacagacagaactgaggtttgaatttatgcccgtccatgccttctccattccactgtaaaggtaggaagaaattgaagatgtctatagactgttttatcatatggtagtgttttatcatatatggtaggattttactatagaaaagaaggagaaaaggtatgatattttggtttcttttttaaatcaaatcctttgaaagagtagtatatagtaggaatctcaatatgagatctaaaattatgattcaaatacatatatttttattgtcttcctttagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaaggtaaccagtcttattctaaagttcgtcagtggccaggtatggtggcttatgcctgtaatcgcagcactttgggaggccaaggtaggcgggtcacctgaggtccggagtttgagacccatgtaggcaacatggtgaaaccctgtctatactaaacatacaaaaattagccaggtgtggtggcacatgactgtagtcccatctacttgggaggctgaggtgggaagattgcttgaacctggaaggcggaggttgcagtgagctaagatggcaccactgcactccagcctgggccaaagagcaagactccatctcggggggaaaaaaaggtctttagtgcagaagaaactggacctgttatcccttgactccatgagtggcacagtgatcacttatataactggccatttacccagtgacttgtagcttgtttgaagttaatttctgattaaggcaagtggggattcagtagcttgtatgtatagatttaaggtagagaatctattttactacaagacaccccaaaaaaaacttagcttagaaggaatattttgcctaggttgtgtatctactagcccaatttaagaaaaaaagaaaaaatatgaaagtggttaattaggaagttgtgtgataagttttagtgttgttaattggattttgcacataattgccaacagttaaaaatctaccactattctaagactaaaatatctgtgaataatacttaaatataagcagtgatattgaaaattttcagtatacagtttgtgagatttatttttttccctttttcttcccaagctaattacagaaatagaaaacatgagacatagaatcattgagattcatcaagaaatgtttaattataatgagcatgaagttagtaaaaggtggacatttgaagaaggtgtaagtgtttttgttttgtaatagtctttaaaatacaaagtaggaataatttatttttctttcaattttgatagtactatctctgttgtaactttatttttgcatatttaagccataacttcagatgtttgtctcatttattgtaatcattatcagtttttccattttccctgatgagttttagaatgtttgaatccagatttacttgaattgcaagatatctgcttaatctgaacaattttattctaattgttcaatttttaaaagtcaacttcttggggttatactttacatacattacaattcacccattttagatatatagtaaaatgaggtaatttcccacagttttaattctttggttttttttgactgctttactgagatataattcacatgccatataattcacccatttaaagtatacagttcaatagttcttagtatattcacagatatgtacaaccatcaccacagtcaattttaaaacataatcaccacctcaaaaaataacaccttaacttttagttgtcactacccctacctcctcagctgcgaccctctacccccagtgctaagataccaccaactgctttttgtttctgtagatttccctataatggcctttcatatgaatggaatcttagaatatggaatcatttcacagatatatgtatatacattgtagtcatcacagcaatcaagatacagaactcttttagcactccaaaggtccccttggcccctttccagccagagttcccctctccactcctagcactaggcagccattgatctgctttctgtcactatggttgttcaattttaaaatattcaacaaagtataaaatgttctgtacattaaaaagcatgtaattggcaaaatggcagaatagagagaaaatgtattatttcatttgtttgtaaagcttaaggaatttaagggttaattttaaaagttttttaaattatgaaatatgattaaaaattttaatcatcaattatatttaaaattatttgtattaacactgtacatgtgcatattttggtgatattggtttactttcattggcatgttacaatttcatttcagattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggtaagaaaatcatgtgctcttaaacttgaatatattataaacattgatctagtgactaaccttttttgtacttctgttgaatgttgttcatataactatatctgttgcattaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaagagtggagaaattcagttgacatttttgagattttaagttatttcaggaaacagtgacaaattgagtggtaagggatggtgtaaagcagagtttggcaaactttttctctaaagggccagatagtaaaagccacgtgttctgactttcaggctttgtaagccattgtagccccgaaacagccataggcagtgtgtaaatatgcatggctgtttcccattattagttgctggatttagcccatgggtgattgttgccagtatctggttataaacgttattttggttgtttaaaccaaagcataaacatttaattactgtttctaggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagtatgcatttgtatttttaagagtatcttctattaaaaaaaccagtggtcagtgtattttcactgtggcaactgtgatgaaagatttggtctgtatgtaatagattttattactaaatgaggacaacagtccctctaaactgatgttgccatttaaaaatttttttcaaattgttttgaattaaaagttttagacattaagattattgggttaaaattgttgtagacattgtgatactttatattttccctttagaaattatcaacaaatttactgattactaagtagaacagaggacttgggagaatacttcataaacaaaagcataggcgttgcctatgttgtaagcacatttagaagtgagatgattttgcttctccatagagtactttttatattttttatatatcaattgaaaaaggcagtgtataggtaataggtaatttctcaagttttaggattttagttattgccaggtctgtttaagatacagatttatagcagtttgcttctagctgcagtttaagatgtttatctttttttttttgagtctgtcgcctaagctggagtgcagtggtgccatcttggctcacttcaacctctgcctcctgggttcaagtgattctccagcctcagcctcccgagtagctgggataacaggcatgcatcaccgcgtccggctgatttttgtatttttagtagacacagtttactatgttggtcaggctgatcttgaattcctgacctcagatgatttgcctgcctcggcctcccaaagtgctgggattacaggcgtaagccactgcacctgggctttttttttttttttttttttttttttgagacagagtttcattgtcattgaggctggagtgcagtagcgtgatctcagctcactgcagcttccacctcctgggttcaagccattctcttgcctcaggctcccaagtagctgggattaaaggtgtgcaccaccacgccagttaatttttgtatttttagtagagatggggttttaccatgttggccaggctggtctcaaactccagacctcaagtgatcctcctgccttggcctcccaaagtggtgggattataggcatgagccaccacgcccggttaagatgtttatctatagttgtagtaaagatttaaattatttgaagcatagagatttttttttatgttttgttttctaattgtcatggtaggtcatgtcatactaaatacaagataggctatagagttttaatttactgtcattgaacaatttgcattgtttaggaggtactaggatgatcaactgattgaaaaattcatcagtgtgttaatgaattttttcacccctttagatatatgctgaaaacatttagcatgagttgtattttaatacaattttcaatattttttcaaattgagacataaaaactaaggcattttaaatatctgtgctctaataaaaatattttagaaatattcattgatgctgctttttacacaggagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagtaagatattagttatattacctatttgaatgataaatgagcattgatatttttgtatggggatttgatgattagtatagattaatacattgttaaattttaaaatgttcgcttagtttactttttcctcagatatatatgggggtaaattcaattttgtaaatgtatatgtacttaacaggaaggcataaggtttgtctttccttcaaaactgttttcccaattttagaatgacaatttaaaccatgactgaatgagagaaggcaggaaggagcaatcctgtgaaaagggaaatgggataaggattgaaccctgaaacccaaatatttaatatataggtcaataaagatggatgggattaatctccagtaggagtgctattttctgagattggagaagaggatggatatggtcccacagaacatgcctagtggcctcatcttccttcattgtaaaagccgaaagttgaggatggttgaagagaatgctccagtggatttgggaaaaggacaagtttaagattaaatttactaagagtacaaatattggctagagcattgctgaagttccagtcttatctgattgtagtaagcaaatacaccagttcctgttaggcatgtgccttttatgattattcgcatttagatttctgttgaaaccactgtagataaactgagaattagttgtgtctgggtgtttgtatatgtgtgtatatatttttgatggctgtgtaaaatttcagtgcaactaatataacagctaatgtttatattagtgtattttaatgtattaatgtatatatttgcgtgcttggcatgatgccaaatgttttatattagctatcttgcagaaaattcatagcagtagaatgagggtgtagggttctgttctcttaatagatgagaggattaaacagagattaggcattttttctgaggtcatgtagctattatcacattgtggagcgaggactgaacctacttcagagtttctgctcttaactgcttgtgtgctgtgtatttagtgtcttatgtttacactgaagaaggtacacaaaagatgagatatgtaattctagcttctagtctggttgaatgatatgattaacaggaagtaagtgtatgaggtagcaaataactgctaggagggctgtgatgtctctcgatcagaatggatttgtcatgcttcatagaggaggttgggcttcatttagttattactggattctgataaactgagcagaggacacagtggcggaagcaagttgaatctcatctaaaagtaacatctgcttgattggaggtttttgtgaagtagtggaagcgtgatcttgactgtgttgtgcattgaaagctagactgaattgatagcacatgcagtaggtagctgacagtagtaagctattggaattttgaccagtgatgttaaatgacattattttaatttggtaaaaacaggcagacaaatcggagattcaacacaagtgtcatttagtccattataagtatagggaatggagtgtctgagtatcaggactatgattttagtagtagaaattttaaaaataaaggagccgcttagaaattttcttaggcagtttcctaagtaaaaacaactttaaatatttaataaagtttgttttttgtatattccagaggatatttttttctttcctttcaggcttctgaatgcttatgatgaacatcaaacactcctgaaagaacaggattctttaaaaaggaaagcagaaaatgggtatgtcactttttgctaagtcaagaaggcgtgcttcattatggaaatgccttcaaagacaaatgtttttaagtgttacttttatgttgtaatttacatactttattttcatgatttgaaaaagtcttgagtgattcagaacttcagtaaaacaaatatacagataacattcatctattcgttaaagttcttacctgtgggagttttgaaagtttccattctgacgttttatatagatcagaagaaccagaggaaaagaaagcacatacagaagatacaacttcatcatctacacagatgattgatggtgatttacaggcaaaccaagctgtatataattatagtgcgtggtatcaagtgagtctgcataattataattctttgttcatagatgttattagcataaattaggatagtttctttttttttaaaaaaagtttttgttccaattgtgtaatacattctttggtggttaagtactagaattttagcagtgaacacttgcttgttttcttaaacatagctgctttaattatacttttacatatggaactctgccacagttctaatatgctaacatacttactttttcctttcagtacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaattgtttatgaatttattttggggggatcaattagtaatattaaccttatgttcacctttattagtggctcattggttttgaagtacaccttttctaaattcaggtcttgatcttcctgccaagatatttctgcttttagcattttgtttcccctcaagccttatgcttttgccttctcattatacaggcaatctgtccagataattttactgggagttactccctggtttgatgaggtccttagttccaattccctaatcagaacaataatatattaacaccaaacaaatcacagtcagatcaagacagtggatcaatttttattgagccacttaagtttacaacatgaggtaaaaggaaaaagttctccttgaccagtattttacacagctgtaggaaagtattttagaccagggattcataagggatttatctctcaaaagctgggaccaagtaaacaaattttattaactccttgaattttccagttgactcttcctttacaatagtaacaagttctaactagttgtgtaaatttcttcaaggccaagttttatcattgttgctaatatccttagagctgaagcactgctatttcaatcaatatccactaattccacttcaaaagtgagttttgcatttggtggaattctgttgaagaagtcaaggtacatttgataaaaagtgcctctcccctacccccataaccttagtgtaggataggctgactagataggctcactagataaattgagcttggactaggatcctccttacctggatgctttacaagtactcctaaattagccaccacttaatgaagactattaagtactccaaaacaaaagtaatgtcattctagctgggggggggtggaacaaaaaaaatatatatacatatagagagagagtattaaagtttttatgaggtagtacataatatttactgtgcattttaagatgctaagttcaaggccaggtacggtagctcacacctgtaatcccaccactttaggaggctgaggcaggtggatcacctgaggtcaggagtttgtgaccagcctggccaacacagtgaaaccctgtctctactaaaaatacaaaaattagccaggcgtagtggtgcgcacctgtagttccagctaccagggagggtgaggcaggagaattgcttgagcccgggaggcagaggttgcagcaagctgagatcacgctgctgcactccagcctgggtgacagagcgagaccctgtctcaaaaaaaaaccaaaacaaaatatgctaacttaagagttatataatttatatgtgcatcagattggtcttgagatgcttcttcacatgggagagggagctgcagctgaccatttgatttccccgccccccccaccgagacagagcctcactctttcctccaggctggagtgcagtggcatgatcacagctcactgcaacgtctgcttcccaggttcaagtgattctcctgccacagcctccagggtagctgggattacaggcctgcaacaccacgcctggctaatttgtgtatttttagtagaggtagggtttcaccatgttggccaggctggttttgaactcctgacctcaggtgatctgccctccttggcctcccaaagtgctgggattacaggcattagccatggtgcccagcctgttcatttgattttgaaaagctaagagagctattatattcccaaatatgtttatctgctaagactacagaaagctgcctcccaaaggacttgttttttcaaacttaatctgatgggtccaagaggaatggaaccaacaaaagccataaacttaccttccctcttacctattggattggtctggtcttaatggtctggagtcattccttattttttttttaaatgttcacaaactggacttatcagtgagtattgtcattagtagtaataataaatgcttacactaacactgttgattctgtggtctccttcagttcacaactggtaatctcccacatctattccatttctaagctttgaatttaattgcctgaaattatactgtaccataaaattaccatgagccatatttgcatcgtagtttgctacagtttgtactgggcatggtaacttttcttaaactcttaaaaacattaagaattgctgtttaagcttaaacttcacagttaaggtcttgaaagttaagaatttgaataagagaaacaaaaattctagctgaggtttgaactttatatcaatagaaaatactattgcctattggaggtgctgacacataagcatctaaagatcaggaagactagtctggacaggattcttgatccagaagtttgcctagacagcatctttcacatcctcaaaggtgatctagacgttttttttttttcaactttaattatgaaggggaaaaaaggatacttggcatcaggctgtcctttctttccgtaagcccattctggttcaatctccagtcgagccttttctcctttactcatagtcaagagagcttcatcccactaaaggcaagaacaaaataaaaactaatggtattttgcaaaaagcacatgcaataccaggacagtcaagacaagattgtatgttaaaacaaacacagaatctattactatagatttcactatattctaagataatgtacttcagtgagtccctaaatctttgtcttccatttcttcaatagaaaaaaaagggtattttaagcagggcttttttaatgtgaaaagaaccttttggggctcatacctataatcccagcactttgggaggccgaggtgggcagatcacttaaggtcaggagtttgagaccagcctagctaacatagtgaaaccccatcttctactaaaaataaaaaaattagctgggtgcggtggtgggtgcctgtaatcccagctactcgggaggctgaggcaggggaatcacttgaacccagaaggtggaggttgcagtgagccaggattgagccactgcactccagtctgggcaacagagtgagactccttctcaaacaaacaaacaaaaaacaaaaaaaaaactttttgtaaactgtaacatgccatacattatgaaaaccagttagttattagcaccatcataaacctgcaacacttttacatcacaggacaaacgagtttatttttattggaatacactggcaagtactcactgtaaaattgttttaagattaccagattgtaatagtggagtcacgttggcacataaaatacatttttttctttttttcttttgagatggagtttcgctcttgttgccctggctggagtgcaatagcgtgatcttggctcactgcagcctctgcctcccgggtttaaccgattctcctgcctcagcctccctagtagttgggattacaggcatgcccagctaattttggaaatacaatttttaaaatgttacggcactaagatcttttgcaaaaggtaaaactaacttttcaaagaaacaataaaagtcttctgggttggcctctccatattttccaaatttggatcttaaagctagtttccacaaacagttaaatccacatcaccaaagggataatattcctaatattatatgctgtattgaaatgcaacaatcatataaagcacaagggacaaagttagggtggtcacatttggaaaataagaatatggtagactagccgggcaaggtggctcgtgcctgtaatcccagcactttgggaggctgaagatgaagagggcgatcacttgaggtcagcactcaagaccagcctgaccaacatgatgaaaccccatctctactaggaatgcaaaattaggtgtggtggcgcatgcctgtaatcccagctattcgggaggctgaggcaggagaatcgcttgaactcaggagacagaggttgcagtaagccgagattgcaccattgtactccagcctggacaacaagagcaaaactccgtctcaaaaaaaaagaatacggtagactagaagaaatttaccagtatgcaaataagttacagaaatagaaaaatggcccaatttgataatatacttgctatcaacttggtacgggcaggtaacaattttttttttttttttgagatggagtcttgctctgttgcccaggctggagtgcagtggcgtgatctcagctcactacaacctccacctcccaggttcaagcaattctcctgcctcagcctcccaagtagctgggactacaggcaagtgccaccatgcccagataattttttgtatttttagtagagacgggtttcacagtgttagccagtatggtctcgatctcctgaccgaccttgtgatccacccacctcggcctcccaaattgctgcaattacaggcatgagccaccacgcctggctggggcaggtaacaattataagttatgctcaactaaacctttagttttaagatgttttatattctgtatatgattgtctgaaccatatcttaggacctactgattgtacagagagtaatatattgaaggttcctataactgcatttaaataggcatttcagttattgatgtctgatgttctgagaataacaatttaaaacaaacaatgggcacaatgggcaggccttagcatgaaaacctgattcatagaaggtgacagtctgccctactcttttatcttcttttgtacagtataatggtcagtacgggtcaagcctaacttcctcttttctcaaagtttctttctgttatctctcacatataagtgtaggttaaagcatgctcatgtttgaatgattttctggtattgcagcctatgttgtatgaggtgaaaaggctgcagaaacaaactctgcttctgtgaatacttcagtgggacagatattttacctttgcaaattatatgtaaatggtacaacagttataagacattttacaggaaccttaaatttagagggccaaacattctgacaaagacttactttatgaagaaaaataataaaatgggtacacatggaagggactaatatttaagcccctactgtattaggtacttcaagttatgctcatttaatcttctaaaaaccttgaggtaggcagtactgtcctcattttatatgtagcgaaactgagaccgagataacttgtgcaagatcagctaacaatgattatacccaatctgtcagactccaaagtctgtttcctttgtattatatccccaaacctaattctttacagcaccataccagaagcagcatatgccagaatatctactgattcattggcattctttacttactcctctgataactttgcctactccgaccttaaaacttaaaggcttggcatttttcttcttctttgcacctgtaaaacagattttccttatcattaatgatatactctaatttattattaagaaatttccattggaaattattaaattccagtggaaaaatatagtggtttgatttcagaattacaatactatgtattttaaaagaaggaaaaaatttacaaagatcatccatcaataaaattctggctgtaaaaataattacattcttaacaaagggtagaggggtaggacctatacttatatcacaaaacagcatactatcctgccttttctattcaaatactaatgccttactttgggacattaaccaggtttagactgagattccttatcttttgctttccaaagaacaagaggtctttagccagccaataatcagtgaactgaagacctcttccaagtagatcttgggggaaagtatgtctggatgaaagtaggtgacagtcaggaaaaaggtactgctaactactcatctgtctgccacccaagtatttagaatctctttaagccaaaaacataagattccatttagacttacttgtttgaatattagtatcaaaaacagtcccatcttgtagtgttcctgtataccagcagtgaacaacatctccctttttgggaaagttggttttatctccctttttcagaacagatttagtatattttggtggaccct

SEQ ID NO: 13993 - DNA, 8850 bp, Homo sapiens
tgatctaccatcgggaattgaagacataaccgatcctgcaaaggtaaccagtcttattctaaagttcgtcagtggccaggtatggtggcttatgcctgtaatcgcagcactttgggaggccaaggtaggcgggtcacctgaggtccggagtttgagacccatgtaggcaacatggtgaaaccctgtctatactaaacatacaaaaattagccaggtgtggtggcacatgactgtagtcccatctacttgggaggctgaggtgggaagattgcttgaacctggaaggcggaggttgcagtgagctaagatggcaccactgcactccagcctgggccaaagagcaagactccatctcggggggaaaaaaaggtctttagtgcagaagaaactggacctgttatcccttgactccatgagtggcacagtgatcacttatataactggccatttacccagtgacttgtagcttgtttgaagttaatttctgattaaggcaagtggggattcagtagcttgtatgtatagatttaaggtagagaatctattttactacaagacaccccaaaaaaaacttagcttagaaggaatattttgcctaggttgtgtatctactagcccaatttaagaaaaaaagaaaaaatatgaaagtggttaattaggaagttgtgtgataagttttagtgttgttaattggattttgcacataattgccaacagttaaaaatctaccactattctaagactaaaatatctgtgaataatacttaaatataagcagtgatattgaaaattttcagtatacagtttgtgagatttatttttttccctttttcttcccaagctaattacagaaatagaaaacatgagacatagaatcattgagattcatcaagaaatgtttaattataatgagcatgaagttagtaaaaggtggacatttgaagaaggtgtaagtgtttttgttttgtaatagtctttaaaatacaaagtaggaataatttatttttctttcaattttgatagtactatctctgttgtaactttatttttgcatatttaagccataacttcagatgtttgtctcatttattgtaatcattatcagtttttccattttccctgatgagttttagaatgtttgaatccagatttacttgaattgcaagatatctgcttaatctgaacaattttattctaattgttcaatttttaaaagtcaacttcttggggttatactttacatacattacaattcacccattttagatatatagtaaaatgaggtaatttcccacagttttaattctttggttttttttgactgctttactgagatataattcacatgccatataattcacccatttaaagtatacagttcaatagttcttagtatattcacagatatgtacaaccatcaccacagtcaattttaaaacataatcaccacctcaaaaaataacaccttaacttttagttgtcactacccctacctcctcagctgcgaccctctacccccagtgctaagataccaccaactgctttttgtttctgtagatttccctataatggcctttcatatgaatggaatcttagaatatggaatcatttcacagatatatgtatatacattgtagtcatcacagcaatcaagatacagaactcttttagcactccaaaggtccccttggcccctttccagccagagttcccctctccactcctagcactaggcagccattgatctgctttctgtcactatggttgttcaattttaaaatattcaacaaagtataaaatgttctgtacattaaaaagcatgtaattggcaaaatggcagaatagagagaaaatgtattatttcatttgtttgtaaagcttaaggaatttaagggttaattttaaaagttttttaaattatgaaatatgattaaaaattttaatcatcaattatatttaaaattatttgtattaacactgtacatgtgcatattttggtgatattggtttactttcattggcatgttacaatttcatttcagattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggtaagaaaatcatgtgctcttaaacttgaatatattataaacattgatctagtgactaacctttttgtacttctgttgaatgttgttcatataactatatctgttgcattaagagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaagagtggagaaattcagttgacatttttgagattttaagttatttcaggaaacagtgacaaattgagtggtaagggatggtgtaaagcagagtttggcaaactttttctctaaagggccagatagtaaaagccacgtgttctgactttcaggctttgtaagccattgtagccccgaaacagccataggcagtgtgtaaatatgcatggctgtttcccattattagttgctggatttagcccatgggtgattgttgccagtatctggttataaacgttattttggttgtttaaaccaaagcataaacatttaattactgtttctaggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagtatgcatttgtatttttaagagtatcttctattaaaaaaaccagtggtcagtgtattttcactgtggcaactgtgatgaaagatttggtctgtatgtaatagattttattactaaatgaggacaacagtccctctaaactgatgttgccatttaaaaatttttttcaaattgttttgaattaaaagttttagacattaagattattgggttaaaattgttgtagacattgtgatactttatattttccctttagaaattatcaacaaatttactgattactaagtagaacagaggacttgggagaatacttcataaacaaaagcataggcgttgcctatgttgtaagcacatttagaagtgagatgattttgcttctccatagagtactttttatattttttatatatcaattgaaaaaggcagtgtataggtaataggtaatttctcaagttttaggattttagttattgccaggtctgtttaagatacagatttatagcagtttgcttctagctgcagtttaagatgtttatctttttttttttgagtctgtcgcctaagctggagtgcagtggtgccatcttggctcacttcaacctctgcctcctgggttcaagtgattctccagcctcagcctcccgagtagctgggattacaggcatgcatcaccgcgtccggctgatttttgtatttttagtagacacagtttactatgttggtcaggctgatcttgaattcctgacctcagatgatttgcctgcctcggcctcccaaagtgctgggattacaggcgtaagccactgcacctgggctttttttttttttttttttttttttttgagacagagtttcattgtcattgaggctggagtgcagtagcgtgatctcagctcactgcagcttccacctcctgggttcaagccattctcttgcctcaggctcccaagtagctgggattaaaggtgtgcaccaccacgccagttaatttttgtatttttagtagagatggggttttaccatgttggccaggctggtctcaaactccagacctcaagtgatcctcctgccttggcctcccaaagtggtgggattataggcatgagccaccacgcccggttaagatgtttatctatagttgtagtaaagatttaaattatttgaagcatagagatttttttttatgttttgttttctaattgtcatggtaggtcatgtcatactaaatacaagataggctatagagttttaatttactgtcattgaacaatttgcattgtttaggaggtactaggatgatcaactgattgaaaaattcatcagtgtgttaatgaattttttcacccctttagatatatgctgaaaacatttagcatgagttgtattttaatacaattttcaatattttttcaaattgagacataaaaactaaggcattttaaatatctgtgctctaataaaaatattttagaaatattcattgatgctgctttttacacaggagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagtaagatattagttatattacctatttgaatgataaatgagcattgatatttttgtatggggatttgatgattagtatagattaatacattgttaaattttaaaatgttcgcttagtttactttttcctcagatatatatgggggtaaattcaattttgtaaatgtatatgtacttaacaggaaggcataaggtttgtctttccttcaaaactgttttcccaattttagaatgacaatttaaaccatgactgaatgagagaaggcaggaaggagcaatcctgtgaaaagggaaatgggataaggattgaacccccccccccaaatatttaatatataggtcaataaagatggatgggattaatctccagtaggagtgctattttctgagattggagaagaggatggatatggtcccacagaacatgcctagtggcctcatcttccttcattgtaaaagccgaaagttgaggatggttgaagagaatgctccagtggatttgggaaaaggacaagtttaagattaaatttactaagagtacaaatattggctagagcattgctgaagttccagtcttatctgattgtagtaagcaaatacaccagttcctgttaggcatgtgccttttatgattattcgcatttagatttctgttgaaaccactgtagataaactgagaattagttgtgtctgggtgtttgtatatgtgtgtatatatttttgatggctgtgtaaaatttcagtgcaactaatataacagctaatgtttatattagtgtattttaatgtattaatgtatatatttgcgtgcttggcatgatgccaaatgttttatattagctatcttgcagaaaattcatagcagtagaatgagggtgtagggttctgttctcttaatagatgagaggattaaacagagattaggcattttttctgaggtcatgtagctattatcacattgtggagcgaggactgaacctacttcagagtttctgctcttaactgcttgtgtgctgtgtatttagtgtcttatgtttacactgaagaaggtacacaaaagatgagatatgtaattctagcttctagtctggttgaatgatatgattaacaggaagtaagtgtatgaggtagcaaataactgctaggagggctgtgatgtctctcgatcagaatggatttgtcatgcttcatagaggaggttgggcttcatttagttattactggattctgataaactgagcagaggacacagtggcggaagcaagttgaatctcatctaaaagtaacatctgcttgattggaggtttttgtgaagtagtggaagcgtgatcttgactgtgttgtgcattgaaagctagactgaattgatagcacatgcagtaggtagctgacagtagtaagctattggaattttgaccagtgatgttaaatgacattattttaatttggtaaaaacaggcagacaaatcggagattcaacacaagtgtcatttagtccattataagtatagggaatggagtgtctgagtatcaggactatgattttagtagtagaaattttaaaaataaaggagccgcttagaaattttcttaggcagtttcctaagtaaaaacaactttaaatatttaataaagtttgttttttgtatattccagaggatatttttttctttcctttcaggcttctgaatgcttatgatgaacatcaaacactcctgaaagaacaggattctttaaaaaggaaagcagaaaatgggtatgtcactttttgctaagtcaagaaggcgtgcttcattatggaaatgccttcaaagacaaatgtttttaagtgttacttttatgttgtaatttacatactttattttcatgatttgaaaaagtcttgagtgattcagaacttcagtaaaacaaatatacagataacattcatctattcgttaaagttcttacctgtgggagttttgaaagtttccattctgacgttttatatagatcagaagaaccagaggaaaagaaagcacatacagaagatacaacttcatcatctacacagatgattgatggtgatttacaggcaaaccaagctgtatataattatagtgcgtggtatcaagtgagtctgcataattataattctttgttcatagatgttattagcataaattaggatagtttctttttttttaaaaaaagtttttgttccaattgtgtaatacattctttggtggttaagtactagaattttagcagtgaacacttgcttgttttcttaaacatagctgctttaattatacttttacatatggaactctgccacagttctaatatgctaacatacttactttttcctttcagtacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaattgtttatgaatttattttggggggatcaattagtaatattaaccttatgttcacctttattagtggctcattggttttgaagtacaccttttctaaattcaggtcttgatcttcctgccaagatttttctgcttttagcattttgtttcccctcaagccttatgcttttgccttctcattatacaggcaatctgtccagataattttactgggagttactccctggtttgatgaggtccttagttccaattccctaatcagaacaataatatattaacaccaaacaaatcacagtcagatcaagacagtggatcaatttttattgagccacttaagtttacaacatgaggtaaaaggaaaaagttctccttgaccagtattttacacagctgtaggaaagtattttagaccagggattcataagggatttatctctcaaaagctgggaccaagtaaacaaattttattaactccttgaattttccagttgactcttcctttacaatagtaacaagttctaactagttgtgtaaatttcttcaaggccaagttttatcattgttgctaatatccttagagctgaagcactgctatttcaatcaatatccactaattccacttcaaaagtgagttttgcatttggtggaattctgttgaagaagtcaaggtacatttgataaaaagtgcctctcccctacccccataaccttagtgtaggataggctgactagataggctcactagataaattgagcttggactaggatcctccttacctggatgctttacaagtactcctaaattagccaccacttaatgaag

SEQ ID NO: 13994 - DNA, 291 bp, Homo sapiens
ccttttttttttttttttttttttttttttttcagatggagtcttgctgtgtcacctaggctggagtgcagtggcatgatctcggctcattgcaagctctgcctcccgggttcacgccattctcccgcctcagcctcccaaagtagctgggagtacaggcgcccgccaccacacccagctaatttttgtttgtatttttagtagagacggggtttcaccatgttagccaggatggtctccatctcctgacctcgtgatctgcccgcctcggcctcccaaagtgctgggatt

SEQ ID NO: 13995 - DNA, 476 bp, Homo sapiens
ggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtaatggtagattatttaaacaaaattccagtaa

SEQ ID NO: 13996 - DNA, 335 bp, Homo sapiens
cccaaagtgctgggattacaggcgtgagccactgcctctggcctctgtgtttaaccatttgcggaactgccaaactgttttccaatttggtggcaccattcattgtagattcccaccagcaatgccccagggttctcatctctccatctcctcgttagcacttgtaattgtctacctttgattatagccaccctagtgaatgtggaatggcttctcatggtggttttgatttgcatttccctggtgtttagcatcttttcacgtgcttcttggccatttgtatatcttcttttttttggagaaatgtctattaaaatcctttgcccatttttaaa

SEQ ID NO: 13997 - DNA, 88 bp, Homo sapiens
ttttttttttttttgagacagtgtctcactctgtcacccagactggagggtagtggcacaatcttggctcactgcaacctccgcctcc

SEQ ID NO: 13998 - DNA, 6162 bp, Homo sapiens
tagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaggctgaacttgtagaacttgtaggtgactgttttatttagtctgtgactgaaagatttaaaaacttggccaggtgcagtggctcatgccggatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaa

SEQ ID NO: 13999 - DNA, 5769 bp, Homo sapiens
  misc_feature (1540)..(1540): n equals a,t,g, or c
acgaaaaagcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctnttcaggttctgttctcagtacatgctcatgccaggcatgggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgctctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaaaggctgaacttgtagaacttgtagatgactgttttatttagtctgtgactgaaagatttaaaaacttggccaggtgcagtggctcatgcctgatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaagaattctaaatcccgggggcctgtgatgccacagtcacatgtctgagcccaaaacaagagaaccacttgt

SEQ ID NO: 14000 - DNA, 6261 bp, Homo sapiens
aagaggtaccatgataaagtctctgggtagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaaaggctgaacttgtagaacttgtagatgactgttttatttagtctgtgactgaaagatttaaaaacttggccaggtgcagtggctcatgcctgatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaagaattctaaatcccgggggcctgtgatgccacagtcacatgtctgagcccaaaacaagagaaccacttgt

SEQ ID NO: 14001 - DNA, 6232 bp, Homo sapiens
tagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcatcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaggctgaacttgtagaacttgtaggtgactgttttatttagtctgtgactgaaagatttaaaaacttggccaggtgcagtggctcatgccggatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaagaattctaaatcccgggggcctgtgatgccacagtcacatgtctgagcccaaaacaagagaaccacttgt

SEQ ID NO: 14002 - DNA, 6168 bp, Homo sapiens
aagaggtaccatgataaagtctctgggtagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaaaggctgaacttgtagaacttgtagatgactgttttatttagtctgtgactgaaagatttaaaaacttggccaggtgcagtggctcatgcctgatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcggg

SEQ ID NO: 14003 - DNA, 3811 bp, Homo sapiens
aagaggtaccatgataaagtctctgggtagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgcttggggggccaagcgcatcatgaagtgagcaaattggatttcctggggacagggtggttacagtcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaa

SEQ ID NO: 14004 - DNA, 658 bp, Homo sapiens
ggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaa

SEQ ID NO: 14005 - DNA, 6259 bp, Homo sapiens
aagaggtaccatgataaagtctctgggtagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgaggtcccacctgttgcacctgatgggggagaaaatcgggactctgggagatgtcttcaaggggtgctaaccatttgcttgtctcaatgcaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaagtgagcaaattgggatttcctggggacagggtgggtacaggcaatgggagagcccctatctgtccacatggactcagccttctcagcgcctgggtctggctttggtgctgacaaagcatagcctgtatcagacaacacggagcctgatgggctctcgaagtgctgtggacgacaccggcgtgtgcccaggggtgcacgtgttcctcctggtggaacctggatgcattttatttttatgactactttccactctagtaactacattttttcattgaaataggaagttttcctaagtagtcttctagtcaattttataaaaatgaacatgtgttggccaggcacggtggctcatgcctgtaatcccagcactttgagaggccaaggtgggtggatcacttgaggtcaggagtttgagaccagcctggccaacatggcaaaacctaatctctacaaaaatatgaaaactagctggacatcgtggtgcatgcctgtaatcccaactactcaggaggctgaagcaggagaatcgcttgaagctaggaggcagaggttgcagtgagccaagattctgccactgcactccagcctgggcaaaagagcaagactgtctcggaaaaaaaaacaaaaaaaagcacgtgtcaaagacttaattgaattcattaattaatgagagaactagcaagaagttacaatcagctcaaaggagatttcaaaatcccacatatatacaggtccaggaagaatgatgagataggttgagtgcagcagctctcacctgggatcccagcactttgggaggtcaaggcaggaggatctgttgagcccatgagtttgagaccagcctcggcaacacagtgagaccctgtctttatcacacgcccgtgtgtgcgcacacacacacacacacaaaatgctggcagtggtagtatgtacctataatcccagctaggtgggaggattgcttgagcccaggagtttgaggctgcagtgagatatgaccatactactgtgtactccagcctgggcaacagcatgagaccttgtctctaaaacgaagaaaaagagagataaatgtatacatacaaaattgggctttttcccctgtgggaatgggagggatgaaataatcttccctccatatgacagaattaatttgcaagtcttatggaccagagtcatttgtactatataatgaacttttcttaaaacttatttttgaaagtctaaccaaatgtctcaagaagcatgagaatatgtgaggttagaacccgctcccgcttccccatttcccctactttccaaacatccaaccccatgttaattgctttatgctatttcagccttatgaccctgggtggcaggtgcaatcccattttacccatgaggaagctgaagctcaaagctagagcagtttgctgaagttcacccagctaataagactggattaggacttaggcctgcctgattcaggttctgttctcagtacatgctcatgccaggcatggatgtcttcatgtccagcactctgaacatgagctagactgcaggtggcttggacaggcctcagagtctagaacagagtgtctcaaggtgcagaaccatgttatggagattaatctggttggtccaaagtagtagtagaaaaataaaagccttatgaaatgagctggggttttgcatgagaaagtagggaggttccgggcatctcagttaaggtggaattgcaggtcctcgcactaatcttgatcccatctgcagcatctgttcctatttgcacatcgctctagaattgatgaaatgcttttagtgctaccacctcagtggtattcaaatgttattaatgaagaaaacaaacataatgaaaccaatcccttccaggccagcatgggaataagggggtgcagggagggggtacactcttgtttttatttattatgtatttatttatttttgagacagagactcactctgtcacccaggctggagtgcagtggcacaatctcagctcactacaacctctgtctcccaggttcaagtgattttcgtgcctcagcttcccgagtagctgagattacaggtgtctgccaccacgcccggctaattttttgtattttttagtagagacggggtttcgccatgttggccaggctggtctcaaactcctgacctcaaatgatccacccacctcggccacctaaagttataggattacaggcatgagccaccaagcccagccttgtgttttttgtttgattgttttttgagactgaatcttgctctgtcacccaggctggagtgcagtggtgccacctcggctcactgtgacctccgcctcctgggttcaagcgattctcctgcctcaggctctggagtaactgggattacagtcacccaccactatgcctgcctagtttttgtatttttagtagagacagagattcgccatgttggccatgctagtctcaaactcctgacctcaggttacccgccctccatggcctcccaaagtgctaggattacaggcgtgaacgccatgcccgacctacttcgtggttttgacttgcgtgccctctcattccacccagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgtatcttctttgcctgtgttctttggggtggggttttatctggaaggttggagggggctaaaggaagagacgaatctattgtcaaagtattctctttaatgtaggattacagctaatggcactttttctaccaaagaagaaaaaaaaaaacagctgggcacagtgacacgtgcctgcagtcccagatactcagcaagctggggtggaagcatcccttgagaccaggagttcaaggccaggctggagcacaatagcaagaccccaggctccttaaaaaacaaaattgcagttgattttgaaactaaagtcagctgaatttgaggcttgagctgaccatgtaattgataccataagtaacaatttcctaattaaattcacctatcagaggagcttcaattgagcaggtgggattaagtcactcttctaatttctcagtgtcccattttataataaccgtttaagtggttaggtgaaaaagtactactcaagctgtaaggcatttctccatcaatgcccatcctaacttgccagacagcttatctttcatgttcaggactttcaacctcgggatttcaaagtgggctcataggtagccccaaagagtaggagcttctcatcagtgtgagctggcattttccagtattggacaactcaagacaagcatgaaaggctgaacttaggctgggcatggtggctcacgccgtaatcccagcactttgggaggccgagccaggcagattacctgaggtcaggagttcaagaccagcctgaccaacatggtgaaacccggtttctattaaaaacaaaaaaattagctggccagcatggcaggcgcctgtactcccagctgtttgggaggctgaggcagtagaatcgcttgaacctgggaggcagaggttgtggtaagccaagatcgtgccactgcactacagcctgggtgacagagcgagactccatctcaaaaaaaaaaaaaaaaggctgaacttgtagaacttgtaggtgactgttttatttagtctgtgactgaaagatttaaaaacttggccaggtgcagtggctcatgccggatatcccggcactttgggaggctgaggcaggagtatcgcttgaggccaggagttcaagagcagcctgggcaacatagccagaccctgtctctacactagataataaaaaaaaattagcagagcatggtggctgtagtcccagctactcaggagcctgaggcaggaggttcactggagcccagtaggtcgcggctgcagtgagctatgattgtgccactgcactccagcctgggcaacagagtgagagcctgtctctgggaaaaaaaaaaaagaggattcaaaaactctatcacagccagccgcagtggctcacgcctgtaatcccagcgctttgggaggccaaggcgggtggatcacaaggtcaggcatttgagagcagcctggccaacatggccaaatcccgtctctactaaaagtacaaaatattggccgggcatggtggtgggcacctgtaatctcagctactcggggggctgaggcaggagaattgcttgaacctgggaggtgcaggttgcagtgagccgagattgtgccattgcactctagcctggacgacagagtgagactccgtctcaaaaaagaaacaaacaaacaaaaaacgaaaaacaaaacaaaacctattgtttcactactcttactataaagcctatttggatgtagtaaatactaaggcaaaggcctatattaccaaagatggtctgggagctatttatggcagcggacccaaaccctgcagcctatgggcaaagcggctgaagctcgctgaagagggcctgctattccgggctctcctgctcttttgcagttatggctggaggctggcccggtgccaggctggctccatggggtgggctgtctggcagggaggcctgatgtttgtattagcacagaagctatcccagtccacccttgatgaagctgtggcggggcctacctgctccttccgtaaagtgctcagtaacagagttggagtgggggtgggaggctcggtatttgtcccaagcttccctcctcctgagatccggagtttcacaagtgaatcttgagcaactgcccatggtctcttggcattgagcccagggaaaacaaggttctttcttttcttccaggagctcgaggctaatggagtcaaagcagctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaagaattctaaatcccgggggcctgtgatgccacagtcacatgtctgagcccaaaacaagagaaccacttgt

SEQ ID NO: 14006 - DNA, 346 bp, Homo sapiens
tagtgattccacagcagagggcctgggctccagttccacctcatagagtccagcccacttgttctgggatggcagaagcatcactgaccttattccccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggtgagggtccacctgttgcacctgatgggggagaaaatccggactctgggagatgtcttcaaggggtgctaaccatttgctgggctc

SEQ ID NO: 14007 - DNA, 309 bp, Homo sapiens
tttttttttttttgagacgcagtctcactctgtcgcctgggctggagtgcagtagtgtgatctcggctcactgcaagctccgcctcccgggttcatgccattctcctgcctcagcctcccaagtagctgggactacaggcacccgccaccacgcccagctaattttttgtatttttagtagagacggggtttcaccgtgttagccaggatggtgtcgatctcctgacctcgtgatccgccggcctcggcctcccaaagtgctgggattacaggcgcaagccaccgcgcccgacccatatatgtattttt

SEQ ID NO: 14008 - DNA, 290 bp, Homo sapiens
tttttttttttttgagacgcagtctcactctgtcgcctgggctggagtgcagtagtgtgatctcggctcactgcaagctccgcctcccgggttcatgccattctcctgcctcagcctcccaagtagctgggactacaggcacccgccaccacgcccagctaattttttgtatttttagtagagacggggtttcaccgtgttagccaggatggtgtcgatctcctgacctcgtgatccgccggcctcggcctcccaaagtgctgggattacaggcgcaagccaccgcgccc

SEQ ID NO: 14009 - DNA, 423 bp, Homo sapiens
ttcccatctccatacttttctaatgtaatgatcagggattttttttttacctaccagcctagacactctgaccccctaatccaaatacttcatattttgaatgattttctcttatctagtttccatttcataaatatctttttcccctttaaaatttaatctggaggcctggtgcagtggttcacccctgtaatccgagcactttaggaggctgaagtgggtagatcgcttgagtacaggagttcaagaccagcctgggcaacatggcaagactccatctctaccaaaaaaatatgcaaaaatagtcaggcatggtggcacatgcctgtagtcccacttctctggaggctgaggcaggaggatctcttgagcctgggaagcagaggttgcaatgagccaacattgcgacagtgcactccagcc

SEQ ID NO: 14010 - DNA, 309 bp, Homo sapiens; identical to SEQ ID NO: 14007

SEQ ID NO: 14011 - DNA, 1893 bp, Homo sapiens
cagagccaagtacataaacatttagtcagttacattactactctgttcaccaaaactagcctagattctctaatattctgccattgaatgatataagtacttattctagaatgaaatttcattttgatgaaatattttgttttcttatttttttgtttctttggtaaaatattttaaaattcagatttaggtaaatctgaataagagttttattccaaaggacattttaaaacttttgtaatatagctttaggatttctctgttagaccaaggataaacataagggttttttttaaaaaaccaggaatagataaagacgattcaggactcagcaggtggagagaggataagtagaatgaggaaaggcagcagtaggtgtgatctgtgtgacctgtaccctaatcccttaactcacctgtagttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtccgccaatctctgttttataccaaaaactatgagattaacaaaaacttttacctttgtg

SEQ ID NO: 14012 - DNA, 4498 bp, Homo sapiens
aaggaggaggcccttcagcaacggagtgggcctgcattctgcggagggtgagactgaggtggctgcagtcaaaggagaagggggcaggggtttgttgaggctgtgaccgtgggaaagcgcttctccagggcttccctcagcttcaaggagaaagagttcagaggccctgaggggatgaagggacttgtgaaggggcttcagggggatgggttggggggaaggaggttcctattcttactccccttctgcctatgctcccccaatgttcctgtctctcccctcccccaccttggccccctctttggcccctgtggccaaagttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaaggttaggcagtggggtctggagaggctggtggaggactggggcttggcttcaatggttatgagaggaggtgggcaggatgttctgtaccaagggccacactgtcccttcctggaagaaacagtgggtacccagcacccagagcttctcccacatgctggccaccgcctctggccccagtagacctggccctcaactgcctcagcaagcctcacaggttggggaccccaccctcattattctcaagtgcatcaaccccgaaggactgaagccccgagtcccaataaacaggtcccatccatccgtaggccagtccgctgggcccctagcaccccctatgggcaggaagcaacactaatggaggaggagcctccagcagcctggggtggggtgggggtgggagagtgagacgtgagggaggagagagacttgccctctaggaagcggacagaccatgcctcaggaaaccccagtgtcacaggtcacagacactgaccttgaagcgttactctcatgggtgaaatttagcccctgtcctcaggaagctcccagtctgacgggggacacatatagtgctctcagagctgccttctttagggtgaaactcagtatctgggcttcaggaaactcccagtgtaaggggagagacacgaccctgcccttagggatctctcaaatgaggcatacccactggactttcgggaaccatcaatctgtttccagacatggattagagatttcaatgcctcaagggctgccaggaaaaaaaatacaagacgtccaattaaattgaatatcagataaacaacgaataatattttagcataagtctgtcccatacaatatttgggacagacttacactatttaaagtatccagtttaactggaagtcttgtgtttttatttgccagatctggtaaccctaggtgcctccagtttgagggaggagagaggacaccccctccaccccagacataggaaagcaggtaaacacctcagcgtgctccggagggcaggggtggggcaggaggagagtcctggggctccggctcgcggcagtttaaaattccttccaggccagagccctaatccctcggtgcacaatggccgccttctcccccgccgcccgcgcccacgccctcccccgcggggccgtggcagtgccaccaagggcctctttaagcccctttgaagccgcggagccccgcgccgcaggaggccccgccgctatgccagctatgccagctatgtccctgctgccgccggccgccaccgctcccccattaatgctggctaatctggctaataaataaactcccctcccagccccagccccgcgccgactcctccccgcccccgcagaatcgatgtcagggctcgactagagcaagcgcccgcactccaccccactccctcgagatgtagctgacgttttttcttatggctgccctaggtctgtagcccgtcggggattctcggggagacgtgggatttgggaggtctccgcctagccactgcgtttgccttcctcttttccagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacaccatttgtcacgctttgatgaatgaaacttactaagaataactcag

SEQ ID NO: 14013 - DNA, 1331 bp, Homo sapiens
gtgaggggcttagcacctgggccagcagctgctgtgctcaatttctccccgggccttagctgccttcccgcggggcagggctcgggacctgcagcctgccatgcctgagactcctcctggctccgtgggctcctgtgcggccagagcctccccgacgagcgccaccccctgctccatggcgcccagtcccatccaccacccaagggctgaggagtgcgggcgcacagcgccggactggcaggcagctccacctgcagccctggtgcaggatccactgggtgtagccagctgggctcctgagtctggtggggacgtggagaacctttatgtctagctcagggattgtaaatacaccaattggcactctgtatctagctcaaggtttgtaaacacaccaatcagcactgtgaatgcaccaatcgacactgtatctagctactctggtggggacttggagaacctttgtgtcaacactctgtatctagctaatctagtggggacatggtgaacctttgtgtctagctcggattgtaaacgcaccaatcagcaccctgtcaaaacagaccactgggctctaccaatcagcaggatgtgggtggggccagataagagaataaaagcaggctgccccagcccgcagtggcaacccgctgggatccctttccacgctgtggaagctttgttcttttgctctttgcaataaatcttgctactgctcactctgtaggtccacgctgcctttatgagctgtaacactcaccgcgaaggtctgcagcttcactcctgaagccagcgagactacgagcccaccgggaggaacagacaactccagacgcgccgccctaagaactgtaacactcaccgcgaaggtctgcagcttcacccctaagccagcgagaccacgaacccaccagaaggaagaaactctgaacacatctgaacatcagaaggaacaaactctggacacgctgtctttaagaactgtaacactcaccgcgagggtccgcggcttcattcttgaagtcagtgagaccaagaacccaccaattccggacacaggaggatcgcttgagcccaggaattcaagaccagcctgggcaacccagcaacactccatctctacagaagttgtaaaattagctgggcgtgatggggcgcatctgtagtcctagctacttatcctagccttggcgagaggatcacttgagcccaggaggttaaggctgcagtgagccatgattgcaccactgcactccagccggggtaacaaagtcagaccgtgtctctaaaaataaataaataaataaaaataaaataaatttgacaaccaa

SEQ ID NO: 14014 - DNA, 518 bp, Homo sapiens
tccctctgcccctcccttcagtggaggggagactttgaaatcaggtgcttggggggggggcgctgctcccagtgggggtgtgaggaacctggaggatgaatccctgtcccccgccctccccctactctattcttccttaccctgcccctttccactccaaaacctcaagcctctggttcacatctgagtgacctttccaaagcaactgttctcagggggtccttgggagccgggaggctgtgaccttaacccacttctttggacagtgccttcctggcactccacccccacctgccacctcctgagaggaacatttcggctggtcttggcaaaaacatcagtctatgatccaggcagcctggtacagtaccagctctgccactgacaccactgtgaccttgggaagccatttacacatatgggtctcagtttctccatatgtaaaatgacttttgtttagctttcctgattttcaaacctttttttcaaacagtgaatcctcttgtttaaattgtaaa

SEQ ID NO: 14015 - DNA, 2065 bp, Homo sapiens
gagaaagtccaggcaggaacctggttgtatatgggaaggaactgatccaagttgggagtttaaaatccaaggaaccagctcagatctgagacttgtgaactaaccttcggggctaacaggccagcaggtcagccaggatggtgagggtgactttgctcccaggcagttttccactccaccctcaggctggaggttgttttaaatattttatgtgagggaagaaagggaagccagcatgatcatctggggctgtctgctaatcgtgagcgtgtgtgtagaggggacagagagttttagacttggcaacagcaatcttttatttatgattaagtataagagtaggatgtaaagtccatttgcgttttagctgttatttaccatgctttaagttaggtgattttaaattattcacattaaattattcacattctcatcgctttagtttcttaaccttatacttctttcaagatgtccgccaacccctgaaaatatgtggcacagttgttggtgcacatatgtgtattttgttgggttagaggtgcacctgactcagtaaagattcagtctgctaattactgtattgctttctcttagctcagatggtataatgcaagcatatatatttcttcattgtaaactgttctcaagaggcgattttctactgattcaagtaaattatagagaggtgagacagatacatttaaaatttacatctttagtctaaccacaacattttttctcatattaatcagcaagcttttaatttttagttcagaaaggagaagtataaagttggaaaaaatgcatgtttgaaagcacacaatgctgccctatatagatagagagagagagagtataaaaatcaaaatgaaacacaacctgcaaatgtcagagaacatatttggaagaggaaatgcagctggatttgcccaaatttgcaaaacaccagatgttcccacagcttgtacatgatgttaaaaatgtaaaataaatgtgtactattcatacacagtgtgcagttttcaaatgtgtacccacatttaatttagaaagaaatttttggaaagaactggtaagctaattctcgagtgcataacaagaacaataagcaattgttcagatactagaattcagaaaggaatattcccaaggcctgaactgagtgcccaatccactggtaaaacataccagagaaggctcttcactttcatggtaacagtcattccattgccatttacatttgcagaattcctagaatctctggggaaaatatttacaaatagtattatgtcctgcagtcagagagtgaatttgtgtgccatttgagatgattaatatgcagaaggaaaaaggaagcaaatgtttaaagtgtatttgtaccaaatctaaatgcttttttttgttgttgttgttgttgaatcagattagagttgctcctctattgcttgtcaattcagctgttataagcatttttatagaagggacagagaacaagtgaatgggttagaaatccaggaaaatggttgtaaaagaggctgaaaggcaggtcagaacacaatttgcttggtattaggtggttagtaatggggagcatatgtataatcttagcctttgtgttttatactttccacttgctgtcaatagctagtactgctacatccatagataaatgcatggcaaatacttctctctcatatgaaatgctgtcaagaagtttgccaggatccttctttaaaaattcccaggtaatcatacagtttaaaaagtccttctggtaccttgcccagtgttactcaacctggaattagataggtatttacccactcccctttcccccaccttgcacgtgctgcctttccaactcccaccgtttgtgattcattgccatcgtaaaccactgcttctaatgggaaacatgttgtctcctttggattgtagcagaaaaattattgagaacctcttatctagcctactttctaaccttcaaactcatttctattgataattaagccagtatccctgcttacttgctttatttatttaataaaaggtatcttttgcctaa

SEQ ID NO: 14016 - DNA, 2066 bp, Homo sapiens
gagaaagtcccaggcaggaacctggttgtatatgggaaggaactgatccaagttgggagtttaaaatccaaggaaccagctcagatctgagacttgtgaactaaccttcggggctaacaggccagcaggtcagccaggatggtgagggtgactttgctcccaggcagttttccactccaccctcaggctggaggttgttttaaatattttatgtgagggaagaaagggaagccagcatgatcatctggggctgtctgctaatcgtgagcgtgtgtgtagaggggacagagagttttagacttggcaacagcaatcttttatttatgattaagtataagagtaggatgtaaagtccatttgcgttttagctgttatttaccatgctttaagttaggtgattttaaattattcacattaaattattcacattctcatcgctttagtttcttaaccttatacttctttcaagatgtccgccaacccctgaaaatatgtggcacagttgttggtgcacatatgtgtattttgttgggttagaggtgcacctgactcagtaaagattcagtctgctaattactgtattgctttctcttagctcagatggtataatgcaagcatatatatttcttcattgtaaactgttctcaagaggcgattttctactgattcaagtaaattatagagaggtgagacagatacatttaaaatttacatctttagtctaaccacaacattttttctcatattaatcagcaagcttttaatttttagttcagaaaggagaagtataaagttggaaaaaatgcatgtttgaaagcacacaatgctgccctatatagatagagagagagagagtataaaaatcaaaatgaaacacaacctgcaaatgtcagagaacatatttggaagaggaaatgcagctggatttgcccaaatttgcaaaacaccagatgttcccacagcttgtacatgatgttaaaaatgtaaaataaatgtgtactattcatacacagtgtgcagttttcaaatgtgtacccacatttaatttagaaagaaatttttggaaagaactggtaagctaattctcgagtgcataacaagaacaataagcaattgttcagatactagaattcagaaaggaatattcccaaggcctgaactgagtgcccaatccactggtaaaacataccagagaaggctcttcactttcatggtaacagtcattccattgccatttacatttgcagaattcctagaatctctggggaaaatatttacaaatagtattatgtcctgcagtcagagagtgaatttgtgtgccatttgagatgattaatatgcagaaggaaaaaggaagcaaatgtttaaagtgtatttgtaccaaatctaaatgcttttttttgttgttgttgttgttgaatcagattagagttgctcctctattgcttgtcaattcagctgttataagcatttttatagaagggacagagaacaagtgaatgggttagaaatccaggaaaatggttgtaaaagaggctgaaaggcaggtcagaacacaatttgcttggtattaggtggttagtaatggggagcatatgtataatcttagcctttgtgttttatactttccacttgctgtcaatagctagtactgctacatccatagataaatgcatggcaaatacttctctctcatatgaaatgctgtcaagaagtttgccaggatccttctttaaaaattcccaggtaatcatacagtttaaaaagtccttctggtaccttgcccagtgttactcaacctggaattagataggtatttacccactcccctttcccccaccttgcacgtgctgcctttccaactcccaccgtttgtgattcattgccatcgtaaaccactgcttctaatgggaaacatgttgtctcctttggattgtagcagaaaaattattgagaacctcttatctagcctactttctaaccttcaaactcatttctattgataattaagccagtatccctgcttacttgctttatttatttaataaaaggtatcttttgcctaa

SEQ ID NO: 14017 - DNA, 106 bp, Homo sapiens
tttttttgtatttttagtagagatgaggtttcaccatgttagccaggatggtctcgatctcctgacgtcgtgatccacccacctcagcctcccaaagtgctgggat

SEQ ID NO: 14018 - DNA, 106 bp, Homo sapiens; identical to SEQ ID NO: 14017

SEQ ID NO: 14019 - DNA, 1817 bp, Homo sapiens
acaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtta

SEQ ID NO: 14020 - DNA, 1817 bp, Homo sapiens; identical to SEQ ID NO: 14019

SEQ ID NO: 14021 - DNA, 332 bp, Homo sapiens
ccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaag

SEQ ID NO: 14022 - DNA, 332 bp, Homo sapiens; identical to SEQ ID NO: 14021

SEQ ID NO: 14023 - DNA, 2227 bp, Homo sapiens
cgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattgtgtatttttccctatatcctacattggatcagaatattactgacatgtatagccatgacgacatggtctcaaaaaatgagaaactttcttagacagtaaaattgttaacttgagatgtctgcttccatcttctagagccaaggaggatctaactttaattagacttagccaataatctgaaactattatagtatctgcctttcacagatacatgcaatattcacttctaaatatttaatgataaatttgtaatcatacatgatagtcaattttaatgattatgttgacaaaattcaggctttttgtgtgaattgaagacttaaagaagtatttgtaaatatgtctgtataagaaccaccagaaagatgaagatgagccgtaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatgagaaacatttacagtttttgcttttactacaagatactgtgaaatgttctgctctgtcagttgtgaaagtatgaaatttaagtctatcactacaataatattttgtttttagtgttcatttttttcctcctgactacattgagatgagttagattgagtgaaaggtaaacactaacatttgaattgaggtaatttccactgtggaaaacaaactgttgttagtaaacaggcatcagctttgagacacagaaaagtcatccaaaccagaagattgggaacttcctcaattactttgtcttccatttattgcattcaattagtcaaaaatgttgttaattatacattttaaagactatttttggtaaggtctatgacacattcaaaatactacatacaagtttgtattatcataaataatccaaaagaaaacatacatgtaaccaccaccatctggaaatttcacactaaattataaaacatttccatcactgcatgtattgtttaatgtcgctttatgaatccaccttcttccttatctgtagagttaaaaactacttagtggattagggtaattcattctacttttaaaaatgatttttccacctctaatgtattctataaaataatat

SEQ ID NO: 14024 - DNA, 748 bp, Homo sapiens
ccactatacttctccagtgattgccagatggcccactatacatcctttcttctatttctttcttttgtggccagaaagtcaggacctcaaagaggtataagtttgtgtgtataattccctggcttttttctaaaattttagtatgcatttatgtggcacttaatatataaaagagttttatgagttttaaaaatgtatataaacaagacatataataaatggtatgtcatttcacaatttactatttttactcaacatttatatttctgagacttttcacatttttgaatgtattcatagtttcactttaattgatgtttgccatgaaagatcaaatatatcacattttatttgactaaaaagtaaactatatttcctacattatgctatagaacttatagactaatttaagttaattataggccttatctcagacctttgcaagtagcctgaataaaacttttcattatttatattatcacatgcatatatgtgtgtatgtatatatgtgtgcatgtgcatgcatagtaaaaatcttaacccaaaactgaaataaaaaattataagagaaaatactattttccaccaatatcacaatggataatcttttttaaatgactacatatgtcgataagttacaaaatccatatatgagtatgacaccaataagaacattttctctaaccattttgaatacgaataaccatggattctaatagcaaacattattaaaatattattgaaataa

SEQ ID NO: 14025 - DNA, 155 bp, Homo sapiens
acacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttt

SEQ ID NO: 14026 - DNA, 3002 bp, Homo sapiens
cccacaggaggcgccggtgggggtgaggcgctgtgctctctgctcatgcccctctgtgtagggcatggccaatttcggataactgctttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcc

SEQ ID NO: 14027 - DNA, 13189 bp, Homo sapiens
ggtaaaaagtgcttaagacctgtagaagggactacatcaggtagggtatgggaatatttaggactactttggtaattattgaaaagtctagagtattaagccactggtggttttgtgaggcacgagtgagttgaacagtttggtgggctttggtgtatctttgctccagaattatatcaccagttagctgttaggtgctgccatttggtaacgtgccaacttttcaaaaatggtttgccccaaactagatttttctatcttctccaaagccagagccaccttcctgtcctagtgcatttttagcagtgccccgtcatcttactggcattcacctgggcttcctgtgctcaatcaggggtcaagtctggcctgatctcagttccacagttcctctactctgtaagttcgagcacaattagcaagccttcgcacctccattttccttacttagcaactacatcaaacacccgagagtttatcatctctcttcatcctcaccctcctttttagtttttatgtatatgttacacattcatacacacaaacatacctgcatatatacatgtgttttatacgtcccacacaactgtgagctgcttacatacaagacagtcttttaacatcattacgcatcactagatgtttaatgttgagtaatgaatttaaactgtttttaacattgaccctccatttttatggttttccacatgtttatactgtatcttgttttttgtttgtttggttttgttgttgttttttgtgcttttttgtttgttttttgtgtttttttgtttttgtttttttgagatggagtctcgctctgtagcccaggctgaagcgcagtgacacagtctcagctcactgcaagctccacctcagcctctgaagtagctgggattacaagtgtgtgctaccacacctggctagtttttgtatttttagtagagacggagttttaccatgttggccaggctggtcttgaacttctggcctcaagtgatccacccaccttgacctcccgaagtgctgggattacaggtatgagccactgtgccccgcctttttgttgttgttgttgtttcttcagttggagacagtctccttctgtcacccaggctggagtgcagtggtgccatcacagttcactgcagcaacaacctcctgggctcaggtgatcctcccacctcagcctcccaggtagcttgggactacaagtgtggaccatcactcccggctaattttttgtattttttatagagatggggtcttactgtgttgcccaggctggtcttgaactcctggctttaagtgatcctcccgcctcagcctcccaaactgttgggattacaggcatgagccactgggcccggctttatactgtaactcatatatttattatcccgtcctaaatagtatcttactgaaaatattttaggatttatgatttcggagatatcagcgatagagtactattggcaaaggttattgaaatgcaaagtaagtcacatttactaggcccgaaaagatgggagaagtgggcaggtaggatgcaattcacttgtaaacctattttctggtggtcttagaacagaacgtggaacttcctattggaaagtaccggaattgtgaattatgaaacttaaaagcttttttttttttaaccatcaaagaatcatcacagcttggttgacccttctactttagaaaaatgctttaatgaataatatttgtctgcaagacacctggaatttatcttcaggaagaagtggaatttccattgtgtttctggcagtatgtagatgaaagaccaggttgctctctaagatggatattaatatttcccctgcaaagagggtgactttgggcaggtcttgggttgttgtgaaggatctcatttatttgaacgcatttcccgtttagaaaaaaaaactgcagttggctgccagcacggtattcttggagcaaacaggaaatgggttaaatgtctgtttcaaaaaaaaatcacccccttaatttttttttcctcctgagttttccaaacgttttattttggaaattttcaaatctacaataaggttgaaataatggtacagttggatgacgctagtggatgcagaagtgactattctgccttgtttgctgaatccttgctgtataccggcacacatgccctttatgctgacctgcttgaaaacaaatgttggccatcttggcacttcacttctaacgactttaagtcgttcctggggcattcttatggcaaatatcgtttaatataataatctatttatactatattctgatgtcttttttttttttttgagatggactctcgctctgtcgcccaggctggagtgcaatgggctcactacaacctccacctcctgggttcaagcgattctcctgcctcagcctgcccagcagctgggattacaggcatgcaccaccacaccaagctaattttgtatttttagtagagacagggttttaccacattggtcaggctgatcttgaactcctgacctcaagtgatccacccacctcggcctcccaaaatgctgtattaggattaactcagttttacaaataaaataaagcttagagaagttgaataacttctcaaggtcatatgctagtaagtgacagaggctagatttaaaccaatacctatgcagagtaaacgacgcttgatacagctgaggagatgacatcgaggttgaaatggattggtaatgcacgccatacgcatgtatttgaggaccctgtgaagtattgcacgagagtgttaggtacgtcagtacttgctgtgtgacatctaaaatttttattaggacattcttatgcccataatcaggcaacaaggagaaatttttttttttttttttttttttttttttttttttttttttttttttttttttgagacggagtctctgtcgcgtgagctgaagtgcagtggtgcgatcttggctcactgcagcctccgcttcccaggttcaagcggtaggagaaataattctattatgtatgaatgtgttaaacgtaaacaacttcagtaatccttcttctgaatacaacattacttctagactgtccatttctgtatttcttagaaccacggtgtgtgaaggagggtacttgcttaggttttaggatgtaaatactgcagatacagattctgagtgaataggagagaagcagttgtcttaggaaggtgtgttacgtttgggctgggcatggtggctcacacctgtaatcccagcactttgggagggtgaggcaggcagaccacctgaggtcagaagttggagaccagcctggccaacatggtgaaaccctgtttctactaaaaatgcacaaattagccaggtgtggtggcacatgcctgtaatctcagcatccttaggaggctgagacaggagaatctcttgaacccgggaagcagaggttccagtgagccaagattgtgccactgcactccagcctgggtgacagagtgacagtctgtctcaaaaaatttttcttttcctttttttttgtttctccagccattctctgtaacagtcttgtggtacatcgagcagagtgcctcacctggggcgctggcggcgtagctcagcggaagaccgctttacttgttttgcttattccactctgggcacacttgaatcctgtttgtctcccctcctaggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggtgagtttgggggattcttattgtatattactgtaaagtgtaggggaggatgggaaggggttctaaataaaaatagatttgtgaaccagaggctgtaatcaagaaagtgttttaaacatttgcctggtctaagtggccgaaagaaacataactcttcaactcataggtcttcagttcacttaggggaaaatgttttgtacacagtgtagttcatagaaatacatggcatatgcccaggtttgtgagcctgacctctacagcagtcctgtctgccagtaaaggagttccccaggagagagaggaatagagccgaggactcttaggcacattcctcctggaatgactcgtagattttccttggtagttaatccagtaatcatatggtactgtcatccagtaatcataaaacccagaagagaagcagccagtgctgtcagtatgcatttgtaaatttggagagtgtgcttgggagggctggctgagatttcagatatggtgtctataggtcgtgtgtctgcagggtgcgggagcaaagagcaggaagaagaagggatccgagcagcattctcctgcctgcagggcttcctgaaggaagtgtgcctgctgtgtaagtgcacgatgctaggacccaggatgtttggcccgcataatccacccaaaagcacatctgtgacaagtatggggtaacttggggcggggagctgtgccagcagtcgagaaggccttgctgacctgggtggttttgtgtgtcggtggcactcttactctttttgacttcagaatctgaagccacatgtagtgtgtaatcaaacagtgaaaacaaatatatcagttacacttgtgaagtaagctccaggaagcattaggaactaaactttgggttggagtgtgtgggtgagcctagcctttgggctgggtcagtcgctgcaggctttggagtttggctcatgaaggaccatcttcatttgagcagctctagaagatgagattgggtgtctgttgcttctgtgaagttgggggtagttttctccattattctcaacattgaatccacttagggaggaaacctggggggacatccctccagccaaggcagtatgttcttaacacacagttggtaaacagggaaagtttggactcaggcctttagagcacttgcggtctagtgggcttcaaagatgaagtgtgattattaagttattatacacagggcaaggacgctgggggagaggggatgcagggtgtagtgccagcatctggggagtaatgaactagatttagactccagacagcaaggaaggggcaatgtcagacccctggcatcagggacacaggttgtcagtaacaggtacttggacccaggctgcctgtcttttaattaacattcagagaagaatgccctgattgccaaggatatattttcagctttgtgaagcaaattttatgtcagttacctgagtagtaagttaaatcggcactttaagcctctttcttcagagcattttaggtaccaagtttgaaatctacgaaatctaatcctcacttagattaaatagtcattcagaagtcagaagagctctgcagatggcctgagaaaggtttgaatattatggttaaaacattcaagaagaaagctttctagaaacgcagctgctatttcagtgcatgttcagttagcattttctgactgataaaatagaattgagagggaggaatgccagtcagggttctatctattgaaaggctctcctagtctgccatcatctagacaacagaatggtagttgtgacgtggagaagtagtatgaataggatcttcccacatctttaacccagaattacttgaggaaatcggggtcttcttttcttttccaggattctgctatgtagaattcgatgaagtggattcccttaaggaagccttgacatacgatggtgcagtaagtatcctcgggttttctctgtcatagcagttgagattgttttctttgccaatacttacactattttccctttatcattagctgttgggcgatcggtcacttcgtgtggacattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgcaagtaagcctctgttagagcctgtgggggcaggacttgagccccatgcaccttgtgtggtcacctttgttagcctgcagctccttggatgtgtacgggcctgggtccttgagctcgctcagcagtctttctcagactctagcccagggaaactcctctgtggttttgtgtatggcaccaagagaagtactgttccttctggaaaacataggatagaggtttgggttcttacatggtgaaaggtagtcctgatggcccttttttttcttggaggattgtggggaggtccagtcccttgatggtggacctgatgcacttcgccgttctctttcttagccaacccaggcagagcagctggtggtatagcacaaagcatcagtccacacgccaggcctctgccctgcagggtgattttaagcatttttatcatctttactttctgtttttaaattacaaaagtataattttttatatatgcacatgataaaaacttcagttgtaacccagaaaggtaggaagagaaaaacaaatttgttttctttcccgcaaacttgggatgtgctgtcaatgctgtgctgtatagaacgtcagcaccctccccccatcaaaacaaaaccggtgtaaagtagtgggtgagtatgggagggactggtgcacgctgtcttgtgagtctgagatttttaaaaactcagctttggctgaacaggtgacgactacctgttgaataatatagttcttaaaagtcctgtagccagtcagaaatgagcttattcataaaagtgcagtatggtgaagtcaatctgtaattttatgtataagctagtctctgattgaaacatgcagcagctgtcttcttagagccaaccagcagctcagggaacggcctttcccctgccagtttggtattcgcaggtgttatagaagttgcccacatactaacgtctttctacccttggcttagcttggccactggcgctcaagcagagacacagtgaacacggccatggcctggccgccaccagttctggtgggaactgcagtgttttggtgacatctcaaaccctatgtgggctcactcgatggagtaatggctaatttgatactttatacgttatttgcgagagtagatcttttttactttttaataggatggtgctattttttttaatgatacctgctcatgtaaaaaacaaaatagagcaacagaaaagtaccaagaaagcaaaaacatttcatcatcagaaatagccagtgttaaactaagctttgtaaagaaaactctgaagattctcatgaatagtttgcttcctagaaacccaccaacagattttttgttgttgttttttttgagacggagtcttgctctgttgcccaggctggagtgcagtggtgcgatctcggctcactgcaagctctgcctcctgggttcatgccattctcctgcctcagcctcccaagtagctgggactacaggcacccaccaccacgcccggctaattttttgtatttttagcagagacggggtttcatcatgttagccaggatggtctcgatctcctgacctcgtgatccacctgcctcggcctcccaaagtgctgggattacaggcatgagccaccgcgcccggcccccaccaacagatttgatgagagatccttgttcatctgcttcaccagcgtggtgtgagctatttgtttcacgctagacattggtggtcgaaatcatttaatctcatagtaaagggtgtaaatttactttgtactcacgtggaaaggtacacttcacagtttagtttgggggaaacgtgaagttaaatgttttaatactaactaggcttgttcactgaactgtgtaatgtgggtaaaatactttgtaaaggaccttatactcgactgtatgcctcccagtgtatttcccctaaagcagtgctcttattggtctaaatctgttcagacttgctttcattacttggtttgttaaaatttattatttaactcagtctctgaactgggtgtgagatcccttggtttccaaaacccttgccacctttaaagaatagaaatcggcccccaccacaggtgatgcagtcagcgcttatcattggaggtggttctgtggagttgctagaacactgaatgagcccgtgcggtgctgctcctgtgtgctacagatcacaacattttcgtcagctgatcatacctaacattgctttatgtgacttttttttttttcttttttttttttttgagacagaggctcactctgttgcccaggctggagtgcagtggcatgatttcggttcactgcaatctccgcctccagggttcaagcgattctcctgcctcagcctcccaagtagctgggattacaggcgcacaccaccacacccagctaatttttatatttttagtagagacggggtctctccgtgttggtcaggctggtctcgaactcccagcctcaggtgatctgcccacctctgcctcccagagtgctgggattacaggcgtgagccaccacacccagcctatgtgaccttgattttaaagacgcctcatttaatgttagtgttgattcatttaatagtgttaacattgaactcagggccagctgtagtaagtagtctgtggtgccatcatttcagcctgttagaaagctcatcccacaccggttttgtctgtaagacacctgacagccagcctgcacttaagaacagcagacagcacttcacactgcacctggggccacttcagacagcgatgtcaccagaaaaagcccaaagggcaaaacacccgacactcatcgtgaaaagacttgacagctaataactgaaacaggcagagcattatcgttttctgcctcagctgggatcgtcgcatctgtgcaggtccaggactgactggagaaatgctgctggtatctagcttgggattacacatgaattttagcgactgggtggatttgcaaatatgggatctgtggataatgaggatgactgtatagtgcatactgcgggctctgggggttcttctcaaagacaagctccctgaaagcttggagccttggcaccactctcgcagagagtagcagtggcaccccctgagtgcgcaaccaacagcagcaagctcatttgtttaattatggtttaacttcttttcgccagtttttttttttttccttgagacagagtctcacttcatcacccaggctgaagtgtaatggcacgatcttggctcactgcaccctctaccttccaggttcgagcgattatcctgcctcagcctcatgagtagctggaaccccaggcgtgcgccaccatgcccagctaatttttgtgttttttgtagagagtgagtctcactgtgttgcccagtctggtcctgaactcctatactcacctcccacctcagcctcccaaagtgctgggattacaggcgtgaaccagtctttttaccaaattttaacatcagtaggttatacagttaaagtttagctttcactgaagtacaagcctgaaggccccttaagaccattgagaaaatactctttcctcctacacaccagtgggaattcagcatttctaaatgagatgcagtttacttctgccaagagcccacttagcaggcacacaaatgaatggggaaagaacgctttgcccccacaggaggcgccggtgggggtgaggcgctgtgctctctgctcatgcccctctgtgtagggcatggccaatttcggataactgctttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcc

SEQ ID NO: 14028 - DNA, 13160 bp, Homo sapiens
ggtaaaaagtgcttaagacctgtagaagggactacatcaggtagggtatgggaatatttaggactactttggtaattattgaaaagtctagagtattaagccactggtggttttgtgaggcacgagtgagttgaacagtttggtgggctttggtgtatctttgctccagaattatatcaccagttagctgttaggtgctgccatttggtaacgtgccaacttttcaaaaatggtttgccccaaactagatttttctatcttctccaaagccagagccaccttcctgtcctagtgcatttttagcagtgccccgtcatcttactggcattcacctgggcttcctgtgctcaatcaggggtcaagtctggcctgatctcagttccacagttcctctactctgtaagttcgagcacaattagcaagccttcgcacctccattttccttacttagcaactacatcaaacacccgagagtttatcatctctcttcatcctcaccctcctttttagtttttatgtatatgttacacattcatacacacaaacatacctgcatatatacatgtgttttatacgtcccacacaactgtgagctgcttacatacaagacagtcttttaacatcattacgcatcactagatgtttaatgttgagtaatgaatttaaactgtttttaacattgaccctccatttttatggttttccacatgtttatactgtatcttgttttttgtttgtttggttttgttgttgttttttgtgcttttttgtttgttttttgtgtttttttgtttttgtttttttgagatggagtctcgctctgtagcccaggctgaagcgcagtgacacagtctcagctcactgcaagctccacctcagcctctgaagtagctgggattacaagtgtgtgctaccacacctggctagtttttgtatttttagtagagacggagttttaccatgttggccaggctggtcttgaacttctggcctcaagtgatccacccaccttgacctcccgaagtgctgggattacaggtatgagccactgtgccccgcctttttgttgttgttgttgtttcttcagttggagacagtctccttctgtcacccaggctggagtgcagtggtgccatcacagttcactgcagcaacaacctcctgggctcaggtgatcctcccacctcagcctcccaggtagcttgggactacaagtgtggaccatcactcccggctaattttttgtattttttatagagatggggtcttactgtgttgcccaggctggtcttgaactcctggctttaagtgatcctcccgcctcagcctcccaaactgttgggattacaggcatgagccactgggcccggctttatactgtaactcatatatttattatcccgtcctaaatagtatcttactgaaaatattttaggatttatgatttcggagatatcagcgatagagtactattggcaaaggttattgaaatgcaaagtaagtcacatttactaggcccgaaaagatgggagaagtgggcaggtaggatgcaattcacttgtaaacctattttctggtggtcttagaacagaacgtggaacttcctattggaaagtaccggaattgtgaattatgaaacttaaaagcttttttttttttaaccatcgaagaatcatcacagcttggttgacccttctactttagaaaaatgctttaatgaataatatttgtctgcaagacacctggaatttatcttcaggaagaagtggaatttccattgtgtttctggcagtatgtagatgaaagaccaggttgctctctaagatggatattaatatttcccctgcaaagagggtgactttgggcaggtcttgggttgttgtgaaggatctcatttatttgaacgcatttcccgtttagaaaaaaaaactgcagttggctgccagcacggtattcttggagcaaacaggaaatgggttaaatgtctgtttcaaaaaaaaatcacccccttaatttttttttcctcctgagttttccaaacgttttattttggaaattttcaaatctacaataaggttgaaataatggtacagttggatgacgctagtggatgcagaagtgactattctgccttgtttgctgaatccttgctgtataccggcacacatgccctttatgctgacctgcttgaaaacaaatgttggccatcttggcacttcacttctaacgactttaagtcgttcctggggcattcttatggcaaatatcgtttaatataataatctatttatactatattctgatgtcttttttttttttttgagatggactctcgctctgtcgcccaggctggagtgcaatgggctcactacaacctccacctcctgggttcaagcgattctcctgcctcagcctgcccagcagctgggattacaggcatgcaccaccacaccaagctaattttgtatttttagtagagacagggttttaccacattggtcaggctgatcttgaactcctgacctcaagtgatccacccacctcggcctcccaaaatgctgtattaggattaactcagttttacaaataaaataaagcttagagaagttgaataacttctcaaggtcatatgctagtaagtgacagaggctagatttaaaccaatacctatgcagagtaaacgacgcttgatacagctgaggagatgacatcgaggttgaaatggattggtaatgcacgccatacgcatgtatttgaggaccctgtgaagtattgcacgagagtgttaggtacgtcagtacttgctgtgtgacatctaaaatttttattaggacattcttatgcccataatcaggcaacaaggagaaaatttttttttttttttttttttttttgagacggagtctctgtcgcgtgagctgaagtgcagtggtgcgatcttggctcactgcagcctccgcttcccaggttcaagcggtaggagaaataattctattatgtatgaatgtgttaaacgtaaacaacttcagtaatccttcttctgaatacaacattacttctagactgtccatttctgtatttcttagaaccacggtgtgtgaaggagggtacttgcttaggttttaggatgtaaatactgcagatacagattctgagtgaataggagagaagcagttgtcttaggaaggtgtgttacgtttgggctgggcatggtggctcacacctgtaatcccagcactttgggagggtgaggcaggcagaccacctgaggtcagaagttggagaccagcctggccaacatggtgaaaccctgtttctactaaaaatgcacaaattagccaggtgtggtggcacatgcctgtaatctcagcatccttaggaggctgagacaggagaatctcttgaacccgggaagcagaggttccagtgagccaagattgtgccactgcactccagcctgggtgacagagtgacagtctgtctcaaaaaatttttcttttcctttttttttgtttctccagccattctctgtaacagtcttgtggtacatcgagcagagtgcctcacctggggcgctggcggcgtagctcagcggaagaccgctttacttgttttgcttattccactctgggcacacttgaatcctgtttgtctcccctcctaggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggtgagtttgggggattcttattgtatattactgtaaagtgtaggggaggatgggaaggggttctaaataaaaatagatttgtgaaccagaggctgtaatcaagaaagtgttttaaacatttgcctggtctaagtggccgaaagaaacataactcttcaactcataggtcttcagttcacttaggggaaaatgttttgtacacagtgtagttcatagaaatacatggcatatgcccaggtttgtgagcctgacctctacagcagtcctgtctgccagtaaaggagttccccaggagagagaggaatagagccgaggactcttaggcacattcctcctggaatgactcgtagattttccttggtagttaatccagtaatcatatggtactgtcatccagtaatcataaaacccagaagagaagcagccagtgctgtcagtatgcatttgtaaatttggagagtgtgcttgggagggctggctgagatttcagatatggtgtctataggtcgtgtgtctgcagggtgcgggagcaaagagcaggaagaagaagggatccgagcagcattctcctgcctgcagggcttcctgaaggaagtgtgcctgctgtgtaagtgcacgatgctaggacccaggatgtttggcccgcataatccacccaaaagcacatctgtgacaagtatggggtaacttggggcggggagctgtgccagcagtcgagaaggccttgctgacctgggtggttttgtgtgtcggtggcactcttactctttttgacttcagaatctgaagccacatgtagtgtgtaatcaaacagtgaaaacaaatatatcagttacacttgtgaagtaagctccaggaagcattaggaactaaactttgggttggagtgtgtgggtgagcctagcctttgggctgggtcagtcgctgcaggctttggagtttggctcatgaaggaccatcttcatttgagcagctctagaagatgagattgggtgtctgttgcttctgtgaagttgggggtagttttctccattattctcaacattgaatccacttagggaggaaacctggggggacatccctccagccaaggcagtatgttcttaacacacagttggtaaacagggaaagtttggactcaggcctttagagcacttgcggtctagtgggcttcaaagatgaagtgtgattattaagttattatacacagggcaaggacgctgggggagaggggatgcagggtgtagtgccagcatctggggagtaatgaactagatttagactccagacagcaaggaaggggcaatgtcagacccctggcatcagggacacaggttgtcagtaacaggtacttggacccaggctgcctgtcttttaattaacattcagagaagaatgccctgattgccgaggatatattttcagctttgtgaagcaaattttatgtcagttacctgagtagtaagttaaatcggcactttaagcctctttcttcagagcattttaggtaccaagtttgaaatctacgaaatctaatcctcacttagattaaatagtcattcagaagtcagaagagctctgcagatggcctgagaaaggtttgaatattatggttaaaacattcaagaagaaagctttctagaaacgcagctgctatttcagtgcatgttcagttagcattttctgactgataaaatagaattgagagggaggaatgccagtcagggttctatctattgaaaggctctcctagtctgccatcatctagacaacagaatggtagttgtgacgtggagaagtagtatgaataggatcttcccacatctttaacccagaattacttgaggaaatcggggtcttcttttcttttccaggattctgctatgtagaattcgatgaagtggattcccttaaggaagccttgacatacgatggtgcagtaagtatcctcgggttttctctgtcatagcagttgagattgttttctttgccaatacttacactattttccctttatcattagctgttgggcgatcggtcacttcgtgtggacattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgcaagtaagcctctgttagagcctgtgggggcaggacttgagccccatgcaccttgtgtggtcacctttgttagcctgcagctccttggatgtgtacgggcctgggtccttgagctcgctcagcagtctttctcagactctagcccagggaaactcctctgtggttttgtgtatggcaccaagagaagtactgttccttctggaaaacataggatagaggtttgggttcttacatggtgaaaggtagtcctgatggcccttttttttcttggaggattgtggggaggtccagtcccttgatggtggacctgatgcacttcgccgttctctttcttagccaacccaggcagagcagctggtggtatagcacaaagcatcagtccacacgccaggcctctgccctgcagggtgattttaagcatttttatcatctttactttctgtttttaaattacaaaagtataattttttatatatgcacatgataaaaacttcagttgtaacccagaaaggtaggaagagaaaaacaaatttgttttctttcccgcaaacttgggatgtgctgtcaatgctgtgctgtatagaacgtcagcaccctccccccatcaaaacaaaaccggtgtaaagtagtgggtgagtatgggagggactggtgcacgctgtcttgtgagtctgagatttttaaaaactcagctttggctgaacaggtgacgactacctgttgaataatatagttcttaaaagtcctgtagccagtcagaaatgagcttattcataaaagtgcagtatggtgaagtcaatctgtaattttatgtataagctagtctctgattgaaacatgcagcagctgtcttcttagagccaaccagcagctcagggaacggcctttcccctgccagtttggtattcgcaggtgttatagaagttgcccacatactaacgtctttctacccttggcttagcttggccactggcgctcaagcagagacacagtgaacacggccatggcctggccgccaccagttctggtgggaactgcagtgttttggtgacatctcaaaccctatgtgggctcactcgatggagtaatggctaatttgatactttatacgttatttgcgagagtagatcttttttactttttaataggatggtgctattttttttaatgatacctgctcatgtaaaaaacaaaatagagcaacagaaaagtaccaagaaagcaaaaacatttcatcatcagaaatagccagtgttaaactaagctttgtaaagaaaactctgaagattctcatgaatagtttgcttcctagaaacccaccaacagattttttgttgttgttttttttgagacggagtcttgctctgttgcccaggctggagtgcagtggtgcgatctcggctcactgcaggctctgcctcctgggttcatgccattctcctgcctcagcctcccaagtagctgggactacaggcacccaccaccacgcccggctaattttttgtatttttagcagagacggggtttcatcatgttagccaggatggtctcgatctcctgacctcgtgatccacctgcctcggcctcccaaagtgctgggattacaggcatgagccaccgcgcccggcccccaccaacagatttgatgagagatccttgttcatctgcttcaccagcgtggtgtgagctatttgtttcacgctagacattggtggtcgaaatcatttaatctcatagtaaagggtgtaaatttactttgtactcacgtggaaaggtacacttcacagtttagtttgggggaaacgtgaagttaaatgttttaatactaactaggcttgttcactgaactgtgtaatgtgggtaaaatactttgtaaaggaccttatactcgactgtatgcctcccagtgtatttcccctaaagcagtgctcttattggtctaaatctgttcagacttgctttcattacttggtttgttaaaatttattatttaactcagtctctgaactgggtgtgagatcccttggtttccaaaacccttgccacctttaaagaatagaaatcggcccccaccacaggtgatgcagtcagcgcttatcattggaggtggttctgtggagttgctagaacactgaatgagcccgtgcggtgctgctcctgtgtgctacagatcacaacattttcgtcagctgatcatacctaacattgctttatgtgacttttttttttttttttttttttttgagacagaggctcactctgttgcccaggctggagtgcagtggcatgatttcggttcactgcaatctccgcctccagggttcaagcgattctcctgcctcagcctcccaagtagctgggattacaggcgcacaccaccacacccagctaatttttatatttttagtagagacggggtctctccgtgttggtcaggctggtctcgaactcccagcctcaggtgatctgcccacctctgcctcccagagtgctgggattacaggcgtgagccaccacacccagcctatgtgaccttgattttaaagacgcctcatttaatgttagtgttgattcatttaatagtgttaacattgaactcagggccagctgtagtaagtagtctgtggtgccatcatttcagcctgttagaaagctcatcccacaccggttttgtctgtaagacacctgacagccagcctgcacttaagaacagcagacagcacttcacactgcacctggggccacttcagacagcgatgtcaccagaaaaagcccaaagggcaaaacacccgacactcatcgtgaaaagacttgacagctaataactgaaacaggcagagcattatcgttttctgcctcagctgggatcgtcgcatctgtgcaggtccaggactgactggagaaatgctgctggtatctagcttgggattacacatgaattttagcgactgggtggatttgcaaatatgggatctgtggataatgaggatgactgtatagtgcatactgcgggctctgggggttcttctcaaagacaagctccctgaaagcttggagccttggcaccactctcgcagagagtagcagtggcaccccctgagtgcgcaaccaacagcagcaagctcatttgtttaattatggtttaacttcttttcgccagttttttttttttttccttgagacagagtctcacttcatcacccaggctgaagtgtaatggcacgatcttggctcactgcaccctctaccttccaggttcgagcgattatcctgcctcagcctcatgagtagctggaaccccaggcgtgcgccaccatgcccagctaatttttgtgttttttgtagagagtgagtctcactgtgttgcccagtctggtcctgaactcctatactcacctcccacctcagcctcccaaagtgctgggattacaggcgtgaaccagtctttttaccaaattttaacatcagtaggttatacagttaaagtttagctttcactgaagtacaagcctgaaggccccttaagaccattgagaaaatactctttcctcctacacaccagtgggaattcagcatttctaaatgagatgcagtttacttctgccaagagcccacttagcaggcacacaaatgaatggggaaagaacgctttgcccccacaggaggcgccggtgggggtgaggcgctgtgctctctgctcatgcccctctgtgtagggcatggccaatttcggataactgctttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcc

SEQ ID NO: 14029 - DNA, 237 bp, Homo sapiens
gcactcctgccagcccagtgtagcctcaggcctgttgggtctacccaggagcatggcagaattatatagcacttggtacttaggaaatgtttttatggtcagttttaaacttataaaatcaagattgaaatataacagacaagaaaacataggtacagaggtaatttggcagaggtcctacatcaagctagctaaggtgtcaagtgaacctgttctcccatgtgttgttattgatct

SEQ ID NO: 14030 - DNA, 237 bp, Homo sapiens; identical to SEQ ID NO: 14029

SEQ ID NO: 14031 - DNA, 794 bp, Homo sapiens
tgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaga

SEQ ID NO: 14032 - DNA, 407 bp, Homo sapiens
aaaactggagttagttctcattacccttaaaaaatactttcttttgtatacacttattaaatatcccactgacattataagttctgaatataagcggttttgaatttaaatacctgtttgtgatcaagacttcatctggataatagtttatagtatttcagactggaaacgtttccaagtttggtaggaggagtagcctctactgtttagagtagttggggcagggcatgccttatacagcttttgcggtttgtgcggtatacaacagcataacatgttgggggtgatgttcattcacatcatagatttgtatattatcacagttttttttagcaggtgttggtaaagtttcttgttctaacaaaatcaatatattatgtcacatttctgacagttaagaaccttaa

SEQ ID NO: 14033 - DNA, 2855 bp, Homo sapiens
tctaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgag

SEQ ID NO: 14034 - DNA, 883 bp, Homo sapiens
cacttacattccttttttatccttttcatcaagggacacagtaattcattcaaactatatattgggaataattaaagggttgctaaaagctgttttaatgtatttaaaacatacattggtatcaacattttctaaattgtaactcaatgtgtttacttgatacaaacatcaactcttggttctttctctatgtaggaaagacatttcagctctgttcattcctgtataatttcttaacacaatgacaccttgattctgacatctttggggagtgaggtgttctaatacagtggttctcaaaattagcaggcatcagcatcacctgcaaggcctgtagtttgctgggccccaccacagaggtttctgtttcagttggcctatggtggggccccagaacttggatttcttaacagttctcaggtggtgttgatgctgttggtccagggaccatacttgagagcctctgctctaatcgatgggaacagactggctggatgactggcctccagggggcgctccattcctgacagcacatcccgccagagctggttgatggacactctaccgggagctgaattttaccacgtaccttctttgcctgttaagggcactgcttcaatgaaacttgcaaggagcaaagaacagattaggtaatttttaattggaacactgatatgagttataggttatttaaatattttgaagctgcaaactgccccttgtttcttttcagttcagagatggaaaaggagtgaaaatccttgaaatagaacttccttttgtaggattactttgcctagaagacaatagataaattcagtgatgtgtggggattgcaaaaattcattttccactttattactttcgttttggcaccagaaat

SEQ ID NO: 14035 - DNA, 5235 bp, Homo sapiens; identical to SEQ ID NO: 10153

SEQ ID NO: 14036 - DNA, 6215 bp, Homo sapiens; identical to SEQ ID NO: 10154

SEQ ID NO: 14037 - DNA, 33958 bp, Homo sapiens
ggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccaggtgaaaatagcgaagagatctatcctatgaacagtacttcagcctgttatctacggccggagagcttttattccatttttcattttttcccccattattattattattattattattattattattatttgagacggagtctcgctctgctgcccaggctagagtgaagtggcgcgatctccgctcactgcaagctccgcctcccgggttcacgccattctcctgcctcagcctcccgagtagctgggactacaggcgcccgcgaccacgcccggctaatttttctgtatttttggtagagccggggtttcactgtgttagccaggatggtctcgatctcctgacctcgtgatccacccgcctccgcctcccatagtgctgggattacaggcgtgagccaccgcgcccggcttttcccctgttcttaactggatagccttatgtgtagaagcgaaattcactctcattatattcattatacggcagttttttttccctgagtttttagaaagaccacaaaaaggtaaccacgtaatatatagaatactctgcttttggttgatgccttaaaaaaatccttcttcggccgggcgcggtggctcacgtcgttaatcccagcactttgggaggtcgaggagggcggatcacgaggtcaggagatcgagaccatcctggctaacacggtgaaaccccgtctctactaaaaataaaaaaaaaattagccgggcgtggtggcgggcgcctgtagtccccgctgctggggaggccgaggcaggagaatggcgtgaacctcggaggcggagcttgcagtgagccgagatcgcgccactgcactccagcctgggcgacagagcgagactccatctcaaaaaaaaaaaaaaatcatttttcacagaattataatagtgttttctagtgtacaagtggctgttaaacactagattcatactaaagctaaatagttcctacaccgtccatttctgcagtttctaaaatcctatttcatttgaggaagaaatgtgcaatattaagaattgggtaattaggattttaggtcaatgcaaatgctagaagatcaaaaaaattttgatttcctaacacaagacagaaatttacattcagttattcacttggcttttgacacatttgcaggtaaatttaatagtgaatgaattaaattacatactctgacttattttattttataaatttcccctgtagccctgacatacctaagatatattttgagaattttcatttttaagcaacctgcaagtgatgtatttttaatcttgccttttaaagtttctttttttttttttttttaaagaattcagtagctttgttgtccggaccaacacatgtggagagttgcgttcgtctcacttaggccaagaagtcaccttgtgtggatggattcagtaccgaaggtaaattgagaaagacagtctaagaatgcatggtggtggttttcccagggcaattccaaacctttactaatttacaaccagtccgaagaataaaacgttttgcaactcctgcaggattaagaacttactgaattttcaactttgttttagttttgaaagacccaagtgtcattctcagtagacattttgaaagacccaaatgtcattctcagtaggtacatctcagtaacatctgttgaagggtataacaacgaagcttgatccaccagtggactgaaatgatactgggcttactaagactgaagagttcctataaccagtaattaaaaatgggccagcctcctataaaccagctgttaaactccaatagcatgggggaaaagctcatcttattccatgtaggtagagaagaagcctagaaacataaacagtgattccttaagatcagagcccattttttgttgttgttcatctctctattccagaacatgcctgaatagaacattaattcacatggaagagattcaaaatacataggttatatgaccttcttaaagaatatgtcccagcctggcgtgtaagcctgtaatcccagcactttgggaggccgaggcgggcggatcacgaggttaggagttcgagaccagcccagccaatatgatgaaaccccgtctctactaaaaatacaaaaaaagttcgccaggcggggtgatgctcgtctgtaattctagctactcaggaggctgaggaaggagaattgcttgaacccagaaggcagaggttgcagtgagctgagattgcgccactgcactccactctgggcaacagaacgagactccgtctcaggaaaaaaaaaaaagtttgtcccaagtaggtggatatttttcccataagtttagtgactgtttcctgaacccaaatctgaagagggtttctgtacctgttcctgatgctgaggatagtatgagaaatagaggttggatgttaaaatgttggcatttctgggaccttttgatgattcatagaggtattaaattagtagttggaactcttccagaaaatgttagattgtatctttttttagaaaaagactatattgctatatttcaaaaatgatccatcagatgtttctattatgctaaaatactatctttggattttactatatgcaaagtttccaaatttaataaaattttcttaaaaggacttaagccaatgaaatttcttttaattgttcatctataataatttttcattaataagccatctgtataagattaatataccaggtaagtagacaataaaaattgaaactgaaataaaaaacaatcttttttttggcaatgagctacatagataacaattgcatgaatgtaactaatgaaggtacataattatcataaaaaacatgaaaaattataattatcataaaaaagaaacatgaaaaattgcatggatttttgtttgctttttattttgtatgcttcaactttggacttagagattttatcttaaaatgtttcttttccccccccccattaatcaggcaaaacacattcttggtcctaagagatttcgatgggcttgttcaagttatcattccccaggatgaggtaatagaaaatttcctgttattatctaaaagcttctttgatgctattgctggggtaagctaagtagttagatgaatatgttagaggttttaaattcagaagtttattgttaatgaaaactgaaaaatataagcaatgttaagacatagcaaaaagaccagtgacccagtagaattaggaacccaggatacgaacaaaaaatttagaggaaaaaaatatataaatggcttgtagacataatgaaagtatgcccagcctcactcataggtagagaaatgtgaattgaaactgcatgtaattgtcatttttaacacattagattgacaacacactgtgtttgggaaagcaggtgctcaatacctggagggagtacaaattggcactagctgaagggagagcaatttggcaatatcaaaactataaatgcatatatcctttgagccattaatttcacttctggtaaattatcttatatctagacttatacagatataaaatgacatatgtacaaggatattcatttcaggattctttttaacggaaaaaaattgggaaccacccagatgtcctccaataagagactggcttaaaaaataatgtatattcttacaatacaatactctactcagccgtacaaaaaagaatgaagaagttctattctaatagggaaaaaaaaatccaaggaatactgttaagtgaagaaccctgtattcttgagtatacaaaagagcagctgttaaactccagcactctaagtgctgtcatctgtataaaaactgggggaaggatgcagaatatacattcagtgtgtgtgtgtgtgtgtgtgtgtgtatttgcttgtatatatgttaggaaatgtctctggaaggatacctaagtatctggtaacattaggtgctgctgggggaaggaactgagggcgttgaaaacaaggataggagggaagctttttactatatctttttgtaccccttgaatttgaagccatgtgacggtattactgctcaaaaaagtatttaatttaattaccattgaaattagataaaatatgacagagtgatattctgaaaaaaaaatttttttaattaaaaaattcaaggccaggcatggtggctcacacctgtaatcccagcactctgggaggccgaggccagcagattgagtacaggagtttgagaccagcctgggcaacagtgaaacctcgtctctactaaaatacaaaaaattggccaggtgcggtggctcactcctgtaatcccagcacttttgggaggctgaggcaggtggatctcgaggtcaggagtttaagaccagcctgaccaacatggtgaaaccccgtctctactaaaaatacaaaaatttagccgggtgtggtggcgggctcctgtaaccccaactactcaggaggctgaggcaaaagaatcacttgaacccagaggcagaggttgcagtgggccgagatcacgccactgtactccagcctaggcaacagagcaagactctatctcaaaaaaataataataatacaaaaaattagctgggtgtggtggcatgtgcctgtagtcccagctacttgggaggctgagttgggagaatcacctgagcccaggaggttcaggctgaagtgagccaaaattgcaccactgcactccagagtgcacaccagagtgataccctgtgtcaaaaaaaaaaattaaaattaaagaattagataaaataaagaacttccatcatacttactgggcaaagttggtttctattgcaatttttactaacgcttgtatgcctaagaaaaatattatttattcagctcttaagttttgaaataaataaagagcaatgaattatcttttagggatcaacatccagagatgagtatagctaaccctggagaactcctttgactctgacccattattgctatgggatttaactgcccctaagactaaccctggagacaattgcttttcaagtatgtgggacttgtttgcactaataatagtcattcttacccttattttcctttaaggaaagtttttttaaagctcttaactaatagttttacttgctgtattatatagagtcaaaatggggatgcagtttttactaaatttggtaataaagtcattaaggagcagccccagcctttatggtaattaagctgtgactattaacgttttttaaaccatctacttataattactgaagattcctgtaagttcatttgtttctcagaactcttttcccccttgttctgtagtcggcagcctctgtgaagaagattttatgtgaagcccctgtggaatctgtggtgcaagtgtctggtacagtcatttcccgtcctgcaggacaagagaatccagtaggtagtttcgaagatatctgtgtaatttttgcttgtatgcatttgcaccatctgtgtacacattctggcaacacatgactggacattaggcactaaagttgaataaattctacaaatgaactgacagatttcaaaatcttgactataaacaaacacatctatgtaaatatgcatgctaagtctcactctgtcaccaggctggagtacggtggcgtgatcttggctcactgcaacctctgcctcctgggttcaagtgattctcctgcctcagcctcccgagtagctgggactacaggtgcatgccaccacgcccagctaatttttatatttttagcagagagagggtttcaccatgttggccaggatggtcaccatctcttgacctcatgatctgcccatctcagcctcccaaagtgccaggattacaggcgtgagccaccgtgcctggccctttttttttttttttcaggacgggtcttgcagtattacccaggctggtcttgaactcctgggcttaagtgatcctcctgtctcagcctcccaagtatcagactgcaaggatatgccatgacatttgttgatatctgaacacatcagccacatatgcataagaatgtcaaaatcatgcacagacatgtatgttttatactatacactataaggactttgcacattttacatatgtaaataaatgcatagattctacaaatgtgtattttgtgtatatcctgatgagtaatttttaaaacccttccttctcactctccaagaaaatgccaacaggtgagattgaaatcaaagttaaaacagctgagcttctgaatgcctgcaagaagctgccctttgaaattaagaacttcgtgaaggtaccaacctctgttattaataaaatagagtatctagaaaatgttgatgactagtcaagtattttcagagttttttaaagaaaagtttaacttctacaaaattaagcattttattgtagacacatcatgaagtgttctcttagttctacaacttcttggcacactgtcctgaaataatgacagttcagtaaactgttgcagtccctaaatacctagactgttttttcagacagattaaaatgtgattctctctttaaaacttgaggtgttatattattcaagtttttcgttgctattgtttaacatttgaaaggaaatttatgtctagcttagaaatggccagatgggacaggggatcctgtatctattaagtgataaaatgtgtgcttagagcaacgcttgacctcccaagcatataaatataaataggattaccataatttagaatgttctttgccaaagtttaagggcttgatggagctgtacactcatatgattttcagctttgtcacagtttatagacttatatattcctaatttttaaactgatctattaacagatttttaattagtcttaattaattagtcttacatttaagttcatggccaattagtcttacatttaagttctcaatacttacgtttaagttcatggccaattggtcttacatttaagttctcaatacttaattatctaattagaaagagcaatgtaattatagagttgaccttattttgaaaaagaaaatatatagttttccccagatgagcattcaaaaagagaagttatagacatttcctaagttttcagcacaaagagggatgcagagatttgtagccttgaaaataagcaaactaggctgggcatggtggctcacacctgtaatcccagcactttgggaggccaaggcagacagatcacaaggtcaggagttcgagaccagcctggccaatgtggtgaaaccccgtctctactaaaaatacaaaaattagccaggcgtggtggcaggcacttgtagtcccagccgctcgggaggctgaggcaggagaatcgcttgaacccgggaggcagaggttgcagtgagccgagatcatgccactgcactccagcctgggtgacacagcaagactccatctcaaaaaaaaaaaaaaaaaagagagagaaaataagcaaactatttctactagtacagccatggagattccatccactgtccctttgcattctttacacttgtagtcagcgtcccattcaggtgaatcttctactctgatgtatctttttttaggagatggggtcttgctatattgcccaggctggcctcaaactcctgtgctcaagtgatcctcccacctcagcatcccaagtagctgggattataggcacatgccaccatgcccagatacagcataatggtgctgtgtatttttctaagagacctttgaaatctttaaatttttttcaagattcaactatgggcttaaattaatggataaatgtttagtaaagtaggcaaatttcagtcagtgaagagtgatattattaataatgaatagtaaaaaaatgtaaaatctgcactgatgacaaacttagaagttgtaggaattaacagcatacagtgggctacttaatgatagaaactaaagacagagctaaaatttttgaaaattcaaactctttctaaagataatacctttctaatattgaaaaatatttaaatataaaaatctttcaatttctttagaaaacagaggctcttcggttgcagtatcgctacttagacttgcgtagtttccaaatgcagtataacctgcgactgaggtcccagatggtcatgaaaatgcgggaatatctctgtaatctgcatggtaagagaaatgcctggatgctctttggagctttgtagcatctcttctattttattcagcagttttattgtatcctttccttagcatgaggtcaagatgttgccagaagtctggaattcactcaatgtgtaatgtagtttttgaagaaaagttaacattattttaaagatgataaagatgatagtcgctattacattgattaatgtattatagtatttcccatcatcatcaaaggcaggacagccctttggctttttctataagatttcttttcttttttttttttgagacggagttttgctctggctagaatgcagtggcattaccacaactcactgcagcctcaaccttttaggcttaaccgatcctcccaccacaccttcccaagtagctaggaccacagacatgcaccaccacacccagccaatttttaaaaattttttgtagagacagggtctcattatgttgcccaggctggtctcaaacttctgggtttaagcaatcctcccacctaaccatcccaaagtgctgggattacaggcatgaaccacgatacccagccagttttcttaattctttatcatgtgcatacatcacttattgggagctcaaaaatgtcatgtgaattaaactagacatctcattcagtcctggactttttctgctatatttgtgttatttctacactaacagaacatttaaaaaatcagaatagttcagtagacaagaatccattaaatatttagaattattttatgtgaacagtatgctttatgaacagaatagtatttatgaaaatcttcagcttccttcttagatttgtagaaaccagcaccagtaggcttggtagcttatttcagctaaaattcttaattaaagggaagcctcagatttgttgtactatattgtggacatcatatatgacaaatttcacattcctatctactaagtgataatgtttctctctttttagggtttgtggatatagaaacccccacattgtttaagaggaccccaggggtatgtatattccttcaatcagtctattaataatgtcctattagttataaagctagactactttgcttttatattcacttggtccacttttatttactgcctcaggatggtcatattaactaggtttttctgaagaattgagaaaattatttgggtattttgagtcagaatcattttattccacataaattttctttcctttgagtttttttgtttttttttttttttttttttttttggtttgttttgggtttttttttttgttttttttttttttttgagacagtctcactccatcacccaggctggagtgcagtggcatgatctcagctaattgcaacctctgcctactggatccaagcgattctcatggctcagcctcctgagtagctgggattacaggcatgcaccaccatgcccggctaacttttgtatttactttagtagagacggagtttcaccgttttggccaggctggtctcgaacacctgacctgaaatgatccgcacaccttggcctcccaaagtgctgggattacaggtgtgagccaccttactcagtctcatttgagttttatagatgtaatcattaataaattggtattttttgtttttgtttttgtttttttagacagtctcgttctgtcacctgaatccgcctactggattcaagtgattcttctgcctcagcctcccaagtagctgggactacaggtgcgcaccaccacacctggctaatttttgtatttttttagtagagacggggtttcgcatgttggcccagctggtctcgaaatcctgacctcaggtgatccacccgcctcagcctcccaaagtgctgggattacaggcgtgagccaccgcgcccagccaatgaattggttctttaagaacaaatctattggccgggcgcggtggctcacacatgtagtcttagtactttgggaggctgaagcaaggaggatgacttgatcccaggagttcaagaccagcttgggcaacaagaccgtatctcttgtcttaaagaccctaaagaaaaaaaaatggaaaagaaaaaaaattattttaaagaacaaatctcttatatattaaaaattgacatttttcggccaggcacagtggctcacacctgtaatctcagcactctgggaggccaaggtgggcagatcacctgaggtcaggagttagagaccagcctgaccaaccatggccaacatggtgaaaccttgtctctactaaaagtacaaaaattaggccaggcacggtggttcacgcctgtaatcccagtactttgggaggccgaagcagatggatcacctgaggtcaggagtttaagacccgcctgaccaatatggtgaaaccccgtctctactaaaaatacaaaaaaaattagctgggcatggtggcaggcacctgtagtcccagctactcaggaggctgagacaggagaattgcttgaacccaggaggcagaggttgtaatgagccaagatcacgccattgcactccagcctgggcaacagagcaagactccgtctcaaaaaaaaaaaatattagccaggtgcagtggcgggaacccataatcccagctacttgagaggctgaggcaggagaaccgcttgaatccagaaggcagagtttgcagtgagtccagattgtaccattgcactccaacctgggtgacagaccaagactctgtctcaaaaagaaattttttttaataaataaaaatggacatttctggccgggcgcagtggctcacacctgtaatcccagcactttgggaggccaaggcgggcagatcacgaggtcaggagttcaagaccagcctggccaacatggcgaaaccccgtctctactaaaaatacaaaaattagcggggcatggtggtggcaggcacctgtaatcccagctactcgggaggctgaggcaggagaatcacttcaacctgggaggaggaggttgcagtgagccgagattgtgccatcgcactccagcctgggtgacaagagcaagattctgtctcaaaaaaaaaaaaaagacatttctaaacattaatagttactcgatttatacagtctatgaaattataaaactacagtttaatttggaaatgcaattaagaattacttggataggaaatgatacacaaaattcattcatctagtaacaaaattggaaattcaattccgcaagcataaacttaacacctaccgtatacaatggtgtttaaagtctactatgtccaagtctttttagggactcaaagataagcaggaaattgtctctgtcattgtaggaactttgttctttagtcattcattgataaactgaagtaacaacttctactagttagttatactttgggtttgtttttgttttttaataatctgtcttctctctctttctctctctttgaaagggtgccaaagagtttttagtaccatccagggaacctggaaagttttattctctccctcagagtcctcaacagtttaagcaacttctgatggttggcggtttagacaggtgagctttttttatgctagcagttgtcagaaaaggaaaagagaaaaacaaagggaaaaaaggaaacacaaaatcctctctgttctcaagagaaggatagaaaatttatgagagtttggagaatacttataaaatgccctcataatttatagtcatcctttattaaaggtttattgggtggccactatgtacaaagctctatggtagtagatgtgagaggggatttaaaaaaaaaaaaaaaagaataggttctactctcaaggtgttaaggctagtaagccagaataggataatgaataaaaccaactgtgatataaaccaaatgtaaatgtattgagatttgcaagttaggtgttaagagctttaaaattatactttttgaggaaatatagaaaactttgtgagctagatcgttgaggacagagctacatttcagcaggtgaagatgagagttggaatggcatagcacagaaagtctcaagtgtatccatggcacagtaaagatttcactttggccaaagcaaaagagtatatatgaagaagcatgggctaaaaaaaatgttttaataaaaagagctggcatggactgatttgcatgctagtctaaatacatgaatatccagaggtgccagtgtttattttgaaaacaatatatagaatagttaacttctcataggtcagctgtatgtctaattcgattaaagcatcataaaaaataaaagtatttcttacttttttttttttgagacagagtctttgctctgtcacccaagctggagtgcaatggcgcaatctcggctcactgcaacctccgcctccctggttgaagtgattctcctgcccttgcctcccgagtagctgggattacaggcgcacgccacccacgcccagctaattttcgtatttttagtagagacagggtttcaccatgttggccaggctggtcttgaacgcctgacctcatgatctgcccgccttggcctcccaaagtgctgggattataggtatgagccgccatgcccggcccttcttacgttttttaagtatcattgttttatagcttgcattgctttaaacttttggggaaaagtgtgtatgtcttcctagaatcataactcaattaatgctatttctcaattgtagatattttcaggttgcccgatgttatcgagatgaaggttcaagaccagacagacagcctgagtttactcaggtacaaagttatattcacttgtttcttaaaattcaggcttactattttgaaatagtattttcaagaccagtgcagtattaatactttacttctcattacattttatccatcagatatttaattaaactcacctgcagttgagaaactaattattcttttttttttattcatttcatgtgtccttttttaaatttttttctttccttggatagcacaggggccacactgtcattcaaattttagtatgtgtgctgccaaaacgagcatgtgtccttttcataaagaatgtggtcagcaactaaggaatgccagaagttcctaaagtgttctaatgttcatgataaagtccttaaaacaaatctcttatatattatgaataattttatatattgatattttaatctaatatgtggacttaccaaagctgttacgatttgctttctgtatgatagcattttattttactttatattattttatttattttattttttgagacagagtctcgctctgtctcccaggctggagtgcagtggcgcggtctcagctcattgctgcctctgcctctcaggttcaagcaattcagctgcctcagcctccgaagtagttgggactacagatgcgtgccaccatgcccagctgattttttgtgtttttattagagatggggtttgaccatgttggccaggatggtctggatctcctgacctcgtgatccacccgcctcggcctcccaaagtgctaggtttacaggcgtgagccaccacgcctggccaatagcattttaatcatgtgttgaagtgaaaaaattatgagctttggagttggacagacctgggatcagatgtagcttcgctgcttactaattgcacatacgcaaataagtaacttagttctctgagccttcatgaaatggttgtgggaactaagcaagttaatgtatgtaaggccattagcacagtgtctgacataaaagagatgtacaataatatttataccctctgcatgtattatgtgcaaaattctatagtaacttgaaagcagaaaaatatataaatgtgtatatattgtggctaaattagtttccatatggtactttggtttcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaaggtacttatcttcacttttctaggactctgtccccaaataatcctgcagtctttttaaaccactttgaaattgacaagtgttacacactgttagatgatatttttgttgttaccttgttaccttcgttgttacagagctagagcaagagagaataatagcatgttagcaatacagtgctttctatctttcatgttccaagatccatttccaagagcgagattcttgctataaagtttttattacttgcaagttattgattatatggatatgaatggtaacttgaaagaaaaaataactattctttccttttcagttttttttttaatccaaggagttactaagtttccttggtccataaaaagctcaaacatatgacaatgtttattcaaattattactatctgtaagtatttaaagcaggggtagaatttatatagaacagtttcattaccaggcctctacttgtttgctcttaaagagcaatatcccttgatccctgtaatgctagtgacatttctatatctcagttctcagtgcacattctttagaaattggtcctgcctggtctgtgaatagtcagtggtcaattcttagaatgaaaaaaatacaatacacaaaaagtcataactaccaacttacagctgccaactcaactacttcttgtttcttcgtttgtaatatggaatagtggttctttttttgtatttttttgagacgtagtctcgccctgttgcccaggctggagtgcagtggtaagatcttggctcactgcaacttcggcctcctgggttcaagcgattctcctgcctcagcctcccgagtagctgggattacaggcgcataccaccacaccggctaatttttgtatttttagtagagatggaattttgccatgttggccaggctgacctcctgacctcaggtgatctgcccacctcagcctcccaaagttctgagataataggcatgagcctctgcgccgagcctggaatcttaatctggttcttaagtcagactgcttgtgttaaattctggctctgccacttactagctatgccatcttgggcaagttccttatttctgtgtcttggtttcatctatgaaatagggataataaagagtgctaacctcatatgaaatgaatgagtatatgtaaaacactggtcatattgcttaacccatggtaaacactctttgaatgtattctataaatgttaaattatcaagatctattctcttctttaaaatcttgtttgtaaaatgttttcagataaaaattacttcatatttagttatctctttttgttacccattttccagattatagatatcagtgatgtgtttagaaacacagagattggatttcttcaagatgcacttagtaagccccatggaactgtgaaagccatatgtatccctgaaggagcagtaagtgaagtacagttctatgtttctctagaatgtatgctttggaagtaactttgtccaatactgtcatatttaaacttcagaaagaacaattctttttaaataaaaatagggatttttgctgggcatggtggctcacacctgtaatcctagcactttgggaggccgaggcgtgtggatcacttgaggtcaggagttcaagaccagcctggctaacatggtgaaaccccatctctactaaaaaatacaaaaaattagtcaggcgtggtggcatgtgcctgtaatcccaactacttgggaggctggggcaggagaatcgcttgaacctgggaggcagaggttgcagtgagctgagatcataccattgcactccagcctgggcaataagagcaaaactgtgtttgaaaaaaaaaaaagtaggtatttttatacagaatctaaagtatttctaaaaccataagtagagaacaataaaattttatgaatgtgagtttacattccagatccggggtgtttttcttttttcttttttttccccccttttaaacaatgctatcagccaggcatagtagctcatacctataatgccaacactgtgggaggtcaaggcaggagaattgcttaagctcaggagttcgagaccagcctggggaacatagacctcatctctacaaaaattacctggcgtggtggctcacacctgtagtcccagctattctggaggttgaggtccaaggatcacttgaggcaaagtgttcaaggctgcagtaagccatgattgtgccacggcattctaacctggataacatagcaagaccgtgtctcaaaaataaatacataaataaatgatgctatgaagtactcctgtacttcattgtggataatatgtgagcataaaataatacgtagtattctgtctgcagcctcagttgtctgtctatctcttagccctgtatcagcaccagcatggccattgcatgttgattctttatcttctgagagttctcatctcagttgcactaataacagggaaataaaaggagatggagctaaaaaagcaaaaaggaaggggaagaagtgggagtagaagagagagagagaatggttgggctgagcaagtgctgactctaaagcaacggtacacgtctcttttctgtaggtagtacatctgctttaaaaaataatttcataagaagtattccagttatattttaaataagattatgattttgaaagtctatactcatttggatacataagcattatattcagaatggagtaagaactcaggaactcagtctcattactttctttttttttttttttttttttttttttttttttagagtgagtcttgctctgtcgcccaggctggagtgcagtggcgcgatcttggcttactgcaacctccgcctcccaggttcgagcgattttcctgccttagcctcctgagtagctgggactacaggcgtatgccaccatgcccagctaagttttttttgtatttttagtagagatggagtttcaccatgttagccaggatggtctcaaactcctgacctcaggtgatccacccgcctcggcctcccaaagtgctgggattacaggcgtaagccaccatgcctggcccctcattactttttatttacttcatatattcagtaaaaagtaatttattgtcatgcggggcacggtagcccacgcctgtaatcccagcactttgggaggccaaggcgggtggattacttgcggtcaggagtttgagaccagcctggccaacatggcgaaaccctgtctctactaaaaatttaaaaattagctgggcattgtggtgggtgcctgtaatctcagctacctgggagactgaggcaggagaatcacttgagcccagtaggcagaggttgcagtgagcatgagatcataccactgcactccagcctgagcaacagagcaacactccatcttaaaaaaaaaaaaaaaaaaagtaatttattgtccatactctagtccagacataagaaatatgttcaggtaagctcagtatgatattttgcctatcattatttacaccatttcaagtttgttctttctcaagtagatataagaactgcaggagtgtggatcatgttttcatctttttataccttccgtacctagttaaatgccacattaatatagttaatgatatgtggcatatgggagaaataagatggttaaagtatgatttcacaaatcacatggtttattgccatacaaagaaaattttttcttaggttcacaatgcttaaaagagagagagaataagggccaagcgtggtggctcatgcctgtaatcctagcactttgggaggctgaggcgggcggatcacgaggtcaggagttcaagaccagcctggccaatatggtgaaaccacgtctgtactaaaaatgtaaaaaattagccaggtgtggttgtgcgcacctgtagtcccagctactcgggaggctgaggcagaagaatcgcttgaaccccggaggcggaggttgccgtgatctgagattgcctcactgcactccagcctgggcaacagagtgagactccctctcaaaaaaaaagaaagaataacatgaacaatcctcacagggaaaacactcagtagctgaggtgcattaatcacatagcgagtgagttccaaaattattaaagtccacttgctctattaggatggaagtagtcctctggggaaggtaaagtctaattaaagtttgaggtgtactcttatatgagctgttcttgggagaagctggtttgaccaccacagtacacactgtatctaaggtccctcgatgctagagggcagtgccagtgtgggtgggtgaggcttcagagattagctccaagactaacagggtatcacccatctcttggctgtaggagaagcagttgacagagtatagccagtcacagcatgtgctatcaaagtgtctgtcgaactcttaagtttatatgtatttttgaagtccagtagttgaggtcagtaattcacacatgggagttatgataaggtttgaggtaacattcctggggggaagagggagttcactcgaagttctcacataggggatctgataaaacatcatgctctcgaaaggagggggaatacaccccaaaacatcaaaccatgttaagtgtttggatcatttcaaagttatgtaacatgataaccataatgtctcacttgaaagacactgagataatttcaaaagaaagattttaagaaacctcaaataatcaaattctgaatccttttattgatctgaaagttttctttcacaattcagttgtagacattcatgttgaacatttatcctgcatattagatatagagggtctcctgtggaatacattcacagctatttccaataagagctgcatgcccagcgtggtggctcacacctgtaatcccagcactttgggaggccgaggctggccaatcacatgaggtcaggagttcaagaccagcctggccaatatggtgaaaccccatccctactaaaaatacaaaaattagccaggtgtggtggtgggcacctgtaatcccagctacttgggaggctgaagcaggagaatcacttgaacctgggaggtggaggttttagtgagctgagatcacgccactgtactccagcctgggtgacagagctagactccatcgcaaaaaaaaaaaaaaaaaaaaaaaaaaaaaaaaaaaaaaatctgcataactggaaaaaataagcactgtaacaagctttaaaaatgtgtcatttggtagcagaaattggatttttttttttttttttttttttttttttttttgagacagaatctcactttgttacccaggctggagtacagtggcacaatctcggctcactgtagcctctgcctcctggtttcatgtgattctcctgcctcaacctcccgagtagctgggatttcaggcacctgccaccataccagactaatttttgtatttttagtagagacggggtttcaccatgttggtcgggctggttttgaactcccaactttcaagcagtccacccgcctcagcctcccaaagtgctgggattacaggcatgagccaccgcgcccagcccagacattgaatttttattaaatcttactattgtaatagaaagacacaaaatatatttgtcatttgatcgcataaccatgtttatgaagctaagtgtcatactgacaagtttactttgatttttctttcatcagaaatacttaaaaaggaaagacattgaatccattagaaactttgcagctgaccattttaatcaggtaaggagttaattagagcagtttttttccttatacagattcaatatttttaactattattaactaaactatcattatcattagttttgagcatcttgttatttcagatcattcttctgcttttatttactttttattttatttatatatttattttgaagatgtagtcttattctgtcgcccaggctagagtgcagtgttgccataacagctcactgctgccttgatttcttaggctcaagcaatgctcctgcctctttctctcaagtagctaggactacaggctcaggccaccatgctgcccagttgcacccctagtcccagctacttaggaggctgaggtgggagaatcacctgagcctgggggtcgaggctacagtgagctgagatcgcaccaccgcactccagcctaggcatcagagcaagattccatctcgaaaaaaaattgggctgggcacggtggctcacacctgtaatcccagcactttaggaggccaaggcaggcggatcacttgaggtcaggagtttgagaccaatctggccaatatggcgaaaccccatctctactaaaaataaaaaaaattggccgggcgcgttggctcacgcctgtaatcccagcactttgggagggcaagacaggcggatcacgaagtcaggagattgagaccatcctggctaacatggtgaaaccccgtctctactaaaaatacaaaaaaattagctgggcgtggtggcgcgggcctgtagtcccagctactctggaggctgaggcaggagaatggcgtgaacgcaggaggcggagcttgcagtgagccgagattgtgccactgcactccagcctggacgacagagcaagactctgtctcaaaaaaaaaaaaaaatgcaaaaatgtgccgggtgtgttggtgctcacttgtaatcccagctactttgagaggctgatgcaggagaatcgcttgaacacaggaggtggaggttgcagtgagctgagatcacgccactgcactactgcctgggccacagagcaagactcagtctctaaataaataaatattagctgggcatagtggcacatgtctgtagtcccagctgcttgggagactgaggcaggagaatcacaagcccaggagttcaaggctgcagtgagctatgattatgccactgcattcttgcctgggtgacagagtgagaccctgtctctaaaaaaaataaaggatccagccaggcacggaagcgcatacctgtaatcccagcactttgggagcccaaggtgggagtatcactggagcccagaagtttgagaccagcctgggcaacatagtgagacctcgtctctacaaaaaacagaaaaaaaattagctgggcatggtggcacacacctgtcatcccaactacttgagaggctgaggtgggaggatcacttgagcccaggagatcgaggctgcagtgagctgtgttcaccccaccgcactccagcctgggtgacacagtgagaccctgtctcaaaaaaaaaggaaagaatcttaggtatgataacaggaataaaatgaaaccatataggagtaattaaattatgctataatcaaaggaattaatattaaagttcctatttaaaatcttgttttctaagacttaatagaggaaaaatgctcttataatgatatgtaagaaaaggaggctataggactatatttatactgattataaccatgtaaaaacactatatttgtatattgaaaatggactacctacctctactaccactatttcccaagcctcatacctcaagcacaacgaacaataagtagatttttatataagaaaaaaagatcaggttagtggttcccaaaatgggttgagacaaaatcagaaaagtcagggcaatataacaagcttttcataaagttaaacaaatttaaagaactatcctttttttctctgtcggcggtggggatggcggggggatgaaatatgtcttttctttataaaattaaaaattggcaaccctttatcttccaattttgtttatttttattttattagtatataaaatctgcatctaagaaccataggaccaggaaataagcctgaaggttaactttggcagctttcagttgatgggactattattacattttcttctttcattcttctctctcttctcctgttttctttttctttcctaatttcctgaacttttatataagaaatgggtattactactactattttttatgagtgttttaacttgatttggcttctaattgctttcagaagatcttatgtgtttttagcaacatatggcatacacatggttcaaaaaataaagaaccattaatgatgaaatgcaataatcatttgctctagcctgccccatccatcctagtattctgccagagtatctctgtttttggaaatatctctacatactttttttttctttttacttaattcatttaaaccttgttaacttcctgtcatgagagatgaggctcacatatacagacctcacctagttactctgtaccttctgcacagctgtctttctgaacctttttttttttttttttttttttttgagacgggagtctcactctgtcgcccaggctggagtgcagtggtgccatctcggctcactgcaagctccgcctcccaggttcacgccgttcttctgcctcagcctcctgactagctgggactacaggcgcccgcgaccacgcccggctaatttttttgtatttttactagagatggggtttcgctgtgttagccaggatggtctccatctcctgacctcgtgatccgcccacctcggcctcccaaagtggtgggattacaggcgtgagccaccgtgcccggcccttttcttcattcttttctgagttgaagccacccatcctggatcccaggttttcctctttcttttttgtgttggagtatgtaatcaagtaacttcctaagaaagcatgtgagagatcaacttactgagttcttacaaaatgtctttatgtttaaaacctcacacttgatcaataataatttggcttagtacaaaattttgaattgacagccatatcatcttagaagagtgctgtccaataaaactttctgtaatgatggaaacgttttatgtctgcattgttcggtgtagttgttgctagccaatgtcgctagtgaacacttgaaataggatagtacaactaaagggctgaactttttactttatttcattttaattaatttaaatgtaaatagcaacagtgcattgctagacagcacagctttagaacatttaaggcattgctttactttcttctcccatctgttgttactgatgagaagtctgatgctttgatgcttgtgtgaatttattccattatagcagagctggttttttctcattggaagctttttgccttctgattctttatgttctgaaatttcagagtttgtttgccttttgatcatttttcatttaatgtgttacacacttgaagagccctttcaatacgaaggtttatgtctttttatgtgtagaaaattattttattatctaatgattttgacctcatcattttttctagtctctctttggaatttctactagttgtatgtcaaaccaatttaacctcttttcttttgcatgtcatttttcaccattttctttgtcttgttctattttcctggggatttcttcaactcttctgttgaatttttttttatttcccagtagcttttttcactgcatcttattctggttttattcataaaatatatttttgagtacctttgaggattcaagttctcttttggtccataacttatgttttctctggggctaattttttgggtttatcttggtcttttttttttttttaatgctgcagagtttcttcaatgtacagtgattgttggttatctgtacatattcaagaaaggggcattttaaaagctggttggggccgggtgcagtgactcacgcctgtaatcccagcactttgggaggccaaggcgggcagatcgcttgaagtcaggagtttgagaccagcctggccaacatagtgaaaccccgtctctactaaaaatacaaaaattagccaggcatgttgacacacatctgtaatcccagcgactagggaggctgaggcaggagaattgcttgaacccgagaggcagactgcagtgagccaagatcaggccactgcactccagcatgggtgacagagcgagactccatctcaaaaaaaaaaaaaaaaagctggttggaagctcaagagagaggctttgtaaatggttaggtttagtttagcatgagcagcaaggctgctctaggcactcaaggcttaagagtcctgagcctctccagaattctgcagggtaaaatcagttccttcttgtgctgaggctgcctccattgttctttatgccagaccttcctgcaccttgcttctttaatcattcctactcagttcacttgcagtctgccaaaaattcgcagaaatctctcatctgctgatattattctccattcttcatcccctccccctttttttcattatgttgaaatgacttttttttttttttttttttgagtctcactctgtcacccaggctggagtgcaatggcccagtctcagctcactgcatcctctaccttccaggctcaaatgattctcatgcctcagcctcctgagtagctaggattacaggtgcacagaactggcacagctactttttgtatttttagtagagatggggtttcaccatgttggccaagctggtgttgaactcctgaggtgatccacccacctcagcctcccaaagtgctgggattacaggtataagccaccgtgccaagcctactttataaaattcccttagtatcattttgaatgggttcatggagataatagagacaatctcttttaaattctcttctattgggaaccggaaatctttgtattataagaagataaattaatcccactgttcaaaaaaaaaaaaaaacgtgaataagtctttttcttttacacaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcagtaagaaaaattacttccaagcatcagtgctgttgatgctgaacaatgccttactctcctatgtatatagtatacgtttgaactgtagactgttaattcataaaatggagctgctctgcataaatcttttttttttttttttaagagacggagttttgctctgttgcccaggttggagtgcagtggtgcaatcttggctcactgcaacctccgcctcccgggttctagagattctcctgcctcagcctcctgagtagctgggattacaggcgcacgctgccatacccgactaatttttgtattttagtagagacagggtttcaccatgttgcccagactggtctcaaactcctcagcttaggcagtccacccgccgcagcctcctgaagtgctaggattacaggcgtgagccaccgtgcccagcctgcataaatcttatagtgctttataatgcactgtataaaaacttaagggttggccgggcatggtggctaacgcctgtaatcccagcactttgggaggccgaggtgggtggatcgcctgaggtcaggagtttgagaccagcctgttcaacgtggtgaaacatcatctctactaaaaatacaaaaattagctgggtgtggtggcgggctaatttttgtattttgtagtcccagttcctcgggaggctgaggcaggagaatcacttcaacctgggagggggaggttgcagtgagccgagattgtgccactgcactccagcctggctgacagagccagactccgtctcaaaaaaaaaaaaaaaagggttttttttcatagctaccagcctccattggcattacttaaatagattagacctgaccctaattagaaaagccacttagattaaggggtagtgaaattagtcatataaccatgaaaaaatattttcagtgtcaagatttcacaaatgaagaaaattaggagtctcaaatttttatacatcatgcattcgtaaattgtggagggacggatcagaccactggcgagctggagggctggcagacacccctggaccaacttggtcaaagtgggaccctttttcctcaagaacagcagctgtaggtgatgagtgccatcatgcactggctgagtcatgattcttcaggggatatggaagactgaattagctttagggatctttgtaaaatatagaaaagtatagtacaaagtcaaatatgaatattaaaaatgtactgtaaagatcaagcatgatataaatttattttttcactttagtatatagttttttcaaaatgatagtgtgtctaactagtacttcatcaagttctttcttctaatctatattttcatttgtcattgtttcttccacagaaaaagtttcagagttcagcttcaaagctaaatgtaatcccccgtctccccttcccctacaatagtaaaatgaagaaagctatttatttccaaattttattatgaatgcatttcttaaaaaagaacatgggattttgttcctaactaatttggctattaaaccttctcttggtatgaactaaacatgctggtgtttcattctcaggaagttataggtctgattcctacaaggccttccttgaaagagagctagaaaccagactttcgaggaataacattaacattctgaaaatgtcacaatgaaggtccgttatgtagacgtaaatgtaagatagaatgggctgcaaaataataccctatcatgtctctaggcatatgtcactgttctaaccagctgtcctttctcagggaagtcctgcataccataggtagcacttattaagcacttagtatttgccaagcccgttctaagcactttgtatacattaactcatttaatcctcatgccaaccctatgaaagaagttctgatactgttgctattttaaaaataagaaaagtgagtcacagagcttaaaattttgctcacagtcacacagctaggaagtggaggagccggatttctaacccatgaagttgggttccaaaattcacactcttatttttttttattttttatttttttttgagatggtctcactctgttgcccaggctggagtacagtggtgtgatctcagctcactgcaacctctgcctcctcccgggttcaagcgattttcctgcctcagcctcccgagtagctaggattacaagtgcatgccaccacgcccggctaatttttgtatttttagtagtgacggggtttcaccatgttggtcaggctgatctagaacccctgaccttgtgatccgcccgcctcggcctcccaaagtgctgggattacaggtgtgagccactgcacccctccgcactcttaaatggacctctaatctgcattacctatagtgatagccagccttcactgaacattaacagtgtgccaggcacttaccaaatcctcaccacaacccttcaagagaagtgaggaaataatcagaacgactaccactcacatactttgtcaggtcctgcaccttatgtatattatcttaagcttcacagcagtcttttggagttgatatttttatcccaattttacaatgaaaaagggtacagagaagttcgtaattagccacactgagattcagacccaggtctatgaagtgctgatccctgtgttcttaatcaccgagttatcagtactcacccagttggttgagtgtgatgattgttctcaaccttgttgcaattagacttatcctcagatctttgtgtcctgagaagcaaagggcatcctatctgttaattggctaatcctttcctagagaatggcctggcttcggaatccaggctgtgtcatttcctgcctgctctgtcaagaagttaactcaatgtttacgtcttctgtttgcagtgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggtaccgtatctatacttccaaatcaaaaggaaatgtgtatataaaggcaaagaacttcagacttcaaggtctgatgaaagataggacccagttctggaagccccagaagaaattgtggagtttgagttagtagtaatacattgtctttaaaaatctacagggtcttcaacccgtagaacagaaaaccagacattttctctaacataaagtatctgtgaatcttctaggcccgtagccaacactatgacttggttttaaatggcaatgaaataggaggtggttcaattcgaattcacaatgcagagctgcagcgttatatcctggcaaccttactaaaggtaacaaacatcatctgctatcctgggcttatttttttaccagaatatttttcagttttgtgttgttgttgttgtttgcttgtttgttttgtttttgagacattctgtcacccaggcaggtgtctactggtgcattcatagctcactgcaatctcagtctcctgtgcttaagccatcctcccacctcagcctcccaagtagctgtgactacaggcacatgccaccatgcccggcaaatttttttatttttttgaagagataagatttccctatgttgctcacactgctctcaaactcctgccctcaagcactcctcctgcctcggcctcccaaagtgctgggattataggcatgaaccactgcatctgacttaaatcagcctattttattaaacatttgttatgattggaggattcacaagatacaaaatagcatcagctatctctctacctttaatgtaggacttggaaaagtaaataataatattaaaagtaaataataatattaaatgcttaaatagtatctggcacatagcactattaaacagtactatttaaatactaattaatagtgcatattaaatacccttattataatagtgcagataaatatccttattctgcccactctaaagatgagatttactgaggcaacttacttaacttgccaaagtgacagtacaaaagtaagcagagtcaggatttgaatccaggtgaggtggctcttaagcccatgctcctaaccactaccctgcttaaaaaaaccatgcagcttgaaaaaataaaaatcaaatcaaatgaaaaccatgcagtctgaagtgactaaaaatgttgataatgttagagaaagagagagaagtttgaaaagattttatatcacttattagatactactttagctatatttaaggcagggatatattttagtgatagtggagtaatcaggattttttaaaagtaaaagaagagtctgtacaggtgcagacctaagaatttgaagtttgttggtgatgctgtagaaggcttgggtaggtttcagaaaggaaaaggtctgagagagtctggtcctaaaagatcgttttgtgggattaactgacaagtgtgaggtaggatggaaggagaactcagaccatgagatgactcctttagctttaagccttcagagtccttaaagtttaagggcattgtgaaatctgttaacttttttttttttttttgagacagagtcttgctctgtcgcccaggctggagtgcagtggctcaatcttggctcactgcaacctccgccgcctgggttcaagcaattcttctgcctcagcctcctgagtagctgggattacacgtgcgcactaacacacccggctattttgtatttttagtagagacagagtttcaccatgttggccgggctggtctcgaactcctgacctcaagagatccacccgccttggcctcccaaagtcctgggattacaggcgtgagccaccgcacccagccgaaatctgttaacttttctcctgccaattcaaagcctccaatcacccattgggttttgtgtgtttgtttgtttgtttgattttaaaaagatggagtctcactctgtcacccaggctagagtgcaatggcatgatcataacttagggcagcctcaaactcctgggatcaagcgatcctcctgcccagcccagcttccagtcagcagttttcagcctttttcattcctctcattgtcaaacttttcaagagtcactaagaatacattacttttttctttttctcgctttgtcacccagactggagtgcagtggcgtgatcttggttcactgcaacctccgcctcccaggttgaagtgattctcctgccttagcctcccgagtggctgggaccacaggcacacaccatcacgcccagcatttttttttttttttgtatttttagtagatacagcattttgccatgttggccaggctagtcttgaacccccaatctcaggtgatctgcctgcatcggcctcccaaagtgctgggattacaggtgtgagccaccacacctggcctagaatacattacttctgttgcttccctaaatagtggttctcagccctgctgcaccttacaatcaaatcacctggaaagcattaaaaaaaacactggtgccttggctacacatcagaccaactgaataaaagagttctaagcataaggctttggcctctgtttgtttgaagcttcccacttgatcctgatttgtagcctggttggagaaccatttccaaacacactttcaacatttctacatgtactgccccacaaaagttactcacaagatcactaaatccagtggcctgttcttggcccttaagttctccttcctcccggcagcatttgacaatgttgcccacttagtaatgctctcttcccttggtctctgtgacaggagagtttcctgctttttatccccacctcctcatttggtctcactctgtttgcattgtgaatacagtaaaagctgcatttactgaacaccaggcatttttgtacatgttataatcatctatgacttgtctttttcccttactaacctgcaaatcacttaaggtaattttttctttacacttttccaataaacttttattattggttaagtcagttttagctgttttaaaactcaactttgtttcccctttatcatctaagcctagatggtggcacttagtggaccttcaaaatatatttaaactgaattatcttttgaatttcaggaggatgtgaaaatgctctcccatctgctccaggctttagattatggggcaccccctcatggaggaattgccttaggtaaacaacttttccttttataagataaactgaattccattgcactgtctcaaattcaggttctcagtttgtgttggtagaggtggaaggatgagtccaagagttccatgagaatgtaagtttctgttgaaatttcagtaatatattttttaaatatatcttaacagttataaagatataacttaactgataatttgcatttgaaagatcattaatagcttaaaactgcagatcttaagtcaatattgttcaaatccccatggcctcacatacgcactcattggagtctggaaagcactgctccataatgttcagcttgtatgaaaacaggaagatgccagtgtccttctgattgccatggttactcactttgcttgttttgtcaaagcaaggaagagtaagaaattctaggaagctcacctagattgtaggccccaacaacagggacttccttctgtgtttatggagttccctgccaagcaccaaatacactgttgaatctgttttagggcctttagtaagcctttactaggaacactaatcgctgtgacaatccaagtagcatgtgaacattagtcctgaatacttttccagaatgagatagaaaagaacctctcaaacaaacaaaagttctctaaaaaggtagggaacgatggttggctacagtttgttaaagattcttatttaaaagttttctacaacttttatagaaaaactaagttatttccaacattagattacatttctcatctgttatctttgtattttactcacagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgttttttttttt

SEQ ID NO: 14038 - DNA, 378 bp, Homo sapiens
atcccctgaagaaaaaaaaaaaaaaccgccaaaatgacagctaagacagaggccagactaacccctggccctcccaaattccctctcgctccacaagtgggttcacaagagacacaaacgcacccaggaagacctccgctccctcagacgcggggcgggccctgcgacttcactctgggagggacatttccgctcacccagctctgcgaccctcgctcctgcggagtcagcttctgctcgcggagggggaagggcaaaaggacagtgcgtcccaacccgtccctctccagctgagcctgtcagagaccagcccagctctgaaatcaagccgttgagaaaagggaattcggccctccgccgcctcttcagtttaaaatc

SEQ ID NO: 14039 - DNA, 3766 bp, Homo sapiens
gattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgata

SEQ ID NO: 14040 - DNA, 4170 bp, Homo sapiens
aatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcacatgacccgtgtgtatttcactcctccactgtaacgggacttttagaacattataaagatcccagttcgtgcatgttttttgaaccattgcttactatatcactaaataggactttcccttttagcctacagtatatctgtcgctcggtgatcttcagttgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgata

SEQ ID NO: 14041 - DNA, 107 bp, Homo sapiens
gagtctcactcttgtcacccaggctggagtgcagtggcccgatcttggcttactgcaacctctgcctcccaggttcaagtgattctcctgcctcagcctcctgagta

SEQ ID NO: 14042 - DNA, 321 bp, Homo sapiens
caggattaaagaattgggaagtttaaagacacctttcctggccgggcatggtggctcacacctgtaatcccagcactttgggaggccgaggccagtggatcacctgaggtcaggagtttgaaaccaacctgaccaacatggtgaaaccccgtctctactaaaaatacaaaaattagccgggcgtggtggtacacgcctgtaatcccagctactcagaggctgaggcaggaggatcatttgaacctgggatgtggaggttgcagtgagccaagatctcaccattgcactccagcatgaacaacagagcgagactccgtctca

SEQ ID NO: 14043 - DNA, 107 bp, Homo sapiens; identical to SEQ ID NO: 14041

SEQ ID NO: 14044 - DNA, 1072 bp, Homo sapiens
aaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactcta

SEQ ID NO: 14045 - DNA, 3544 bp, Homo sapiens; identical to SEQ ID NO: 13376

SEQ ID NO: 14046 - DNA, 414 bp, Homo sapiens
ctcctcagttaagtgagagggaactccacctgttgtaaaactattcttagtagtctggattgtgttttttcattttaatagccatataaaattattcagatgattcagaataagcaggatctattttaaggtcccacatgataggttcttacttcagatcaaggaggtgaaaggttttaaagttgggaatttgggataaattctgtattggtggtgtgtaagtttttcttcaccattgttttaattacttacaaaggtaaaacttcaccgtctcctaatgccaaagcctactggggatgggtatttcacttgagattacttcccaatttttattctgtcttccagaggattaaagatggaactctaataccagttatgacaagattcttagtagagagttctccacaaccaggt

SEQ ID NO: 14047 - DNA, 397 bp, Homo sapiens; identical to SEQ ID NO: 13377

SEQ ID NO: 14048 - DNA, 20905 bp, Homo sapiens
agtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtaatgttacttaaaacttcattattcattttttatatagcattacaatttgactcatagtgcatatggaattaatactgtttctaaactcaagatctttggcggattaaaaatgaactgaggaagggaatgtttgctggagctgtattatttaaattcgtgataattgaattttttctaaaacttcaactctttatccaacaaaaatgtgtttattggggatttcctatggactaagcattaatgtaggtgctagagattgagctgtgaaagagacaaagcctttgccttcatggggcttttgtcctagtcaaagggttagataaacaagtaaatgttgattatattatcatgtcaggtagtagttaagtactacaaatgaaaataaagcaggacatgagtacagcaagaccagatgctatgctatttcatataaggctggcagggaaaggcctttccaaaataaccttggagcagagacctaaatgaaatgatggagtgagtcatacctacaaccagaatttgagttgaacttctgcaaccatatggaggatgaacatgtataatttttgttaggcctttttaaaaattatatttttcagtcttttttggtggaaaaattaaaatatgcaaaagtaaggcaaagagtataataaattcctaagtatcactttgcttcaataattgagacataatcttgcctaatgtaaaaccgaccctatatttcctttccctgctcatcagattattttgaagcaactgttacgcttttttaaaaattgatacacaatggtaatacatattttgggggtgttaggcttttttttttttttttttctgtaagacagcatctcctgtcacccaggcaggagtgcagtggcgcagtcttgtctcagtgcagcctctgccttccggattcaggcgattctcattcctcaacctcccgagtagatgagactatagatacatgccactccgcccagctaatttctgtgtatttagtagagacagggttttaccattttggccaggctggtctcaaactcctggcctcaagtgattcacctccctcggcctcccaaagtgctgggattacaggcttgagccaccacacctggccaggtgttaggcttttaaaaatactggaataggatccctaaagtgcaagaaatcccaaatcaggaacatatatggtcttgtacagctctcatacacatttgtatttagatcagtttatctttccaagaaggactgtttaaatatcaatgggagatatgatgtagtacaaaacgtgaaagccaagtgaaattctgctaaatgtatctgttcagtccatttaagatagtataagtaaaactgaatctgtgtattgtgtacattttagcagattctagactccatgctatttctaaaaatgtgctctgttttgtactagtgcttccattatgtcaagaagggttgtagatgatctgttgggtgttttattctactgttctgtttgaaaagaaatcttacatgttcttttttttcaggtgcctgaactctgtctgggcataaatgaactctccagtcatccccacaacctcctgtggttggtacagctggtccctaattggacatcacgtggaaggtattaaaaagtgaaaattaaacattaagaaattttataattttacattaatgaaatgccttgggttgtttatttccattcatcattctttgaatgttagatcagatatgtttatttcatattcagttgcgagaaaaggcattgatagcctgattctgccttattctaattcttaactcaggtcattatgtaatttttttttttttgagacaagagtctcactctgtcacccaagctgaatatttttttatttttaattttagtttatctgttaccttaatacagatgacatattccacaaaaataaatgaattagcttttttttgctttagtaaaaataaatttcatcagtaaaaaaataggttttctgtcagtaaatcatcagggtcaaagataaggccgttaaatgatttattgagcttcagataactcaagttttatgtacagatattttacatgaaaattttactgttctataacagcttatatgttcctgtacagacttctcttgaaacattgcctatatttccaattagaactagagctcctcttggctcattcatttgcttttcaagcagtattaattaaaatacattctaaatacttttaacttctaattctaggcaactgagacagtgcctcagtctagtgattatttcaaagcttttggatgagaaacacgaagatgttcctaatgccagtaatctgcaggtataaataaatacatttttatttttaataaatgggagaggtaatgagaggtgtaaggaaaattgatgaaccctaagtcaaaggtcctggggtcagagctcagctcttaagcttgatactgttcatgtaatctctagcacacttaactaacaagatccaattttttcatctgtgaaatggagataatattgcaccctccaccacttagggtggttgtggacaatcagatgtgaattaatgtataaagaaactactgggaaaatcataatgtgcaattatatgaatatgatttcatttattgaattagttcagcttttccaagttagcaattttatcacaagattagaaattgcaaaacccttgtacattgattgcatctttaacctgttttaaaatgagtctttttagatcatagagcttaaatgtagttgccctctagtacttgttcagtaagaatatatcatgtatatatgagagtgtggataaacatgtccagctgttgctgggtactggtggcacacacctatcgtcccagctacttgggaggctgaggccagaggatcctttgaatccaggagttcaagtccaacctaagcaacatagggagaccttgtctttaatatatatatgaatgtttttaattaaaaaaaatgtccaatggaagtcccactctgagtaaaattctgaaggctttttataaacattgatagcactaatggggctgcccttgcttggatttgaaaactcaccataggatgggcacagtggctcacgcctgtaatcccagcactttaggaggccggggcaggtggatcacgaagtcaggagatcaagaccatcctagccaacacggtgaaaccccgtctctactaaaaaaaatacaaaaaaattacccgggcatggtggcggacacgtgtagtcccagctactcgggaggctgaggcaggagaatgacatgaacccaggaggtggagcttgcagtgagccgagatcacgccaccgcactccagcctgggcaacagagcgagactctgtctcaaaaaaaagccccatagaacctgatctggatgtccctttgttcttgtttgaattgcaatttggtacaaggtatgccaccagatcctaggaattaaaacaaacaaagatttagattagagactctgcccttgaaaacataatctaatggttgaaacaaaattaaccaactcttatgggttagtgtggtaagaacagtaatcgaagcatgcacgagatgctgtgggatggagagactgatgggcacagctggtttctgctttagtagaattgaggtagatttgattccagatatatggggatcatgctggagctaccaggataattagcagatagttctcattcctttcattgatatttactgccttcaaaagagatccggggataggatttctaccatttctcctaacttttgttgttctgttactttttccttttttgcccatgtaaaatagaataattagctgaataattacatgaataattaaccctcaaactcactaactgatattcaagtaacaatctagttgtgatttttaccacaacttcttgtagttcttctcagaattcaatgacttctaaccacagagtcaactttgttgactttcaaataatttaacagagaaagcattccctgtggcctctatgataatatcgtttggtctcctaagcatttatcctaagttacaagtactaaatctttaacttaaaatccctttttttttttttgagagatgtagtattgctctgtcacccaggctggaatgcagtggcacaatctcggctcactgcaacctccaccccgcatattcaagtgattctcgtgcctcagcctcccgagtagctaggactacaggcatgtgccaccatgcccagctaatttttgtatttttagtagaggcggggtttctccacgttggccaggctggtcttgaacctctaacctcaggtgattcacctcccttggcctctgaaagtgttgggattacaggtgtgagccaccgtgcccgaccacttaaaatccctttttaagcaattcagggttttacataaagggaaaatggatattgttaagtgtaaagaaagctataataaaaggacaaaatgaaagagtacacactggaaaaaaatagcctaagaaagaacaactatattatttagctttgttcaatgtctcctctttcttttgataggtatcagtcctacatcgctatcttgtgcagatgaagccttctgatttgttaaagaaaatggtcttgaagaaaaaggctgaacaaccagatggcattattgatgacagtcttcatttagaacttgaaaagcaggtatccagtgctagaaggtctcaaagagtacatagaagcataactgttatcagcttactaaccatagactgatatgtaggcatttctggatttggacactagacacattctagcaaacataattttaaagcgaataatatttttaatttatcactgtcatgaaattcttccataaatttgagagttgaaaatttaggtaaaaggatgattgttggtaatttgctcccaagagtattttttgtagccctttattagggcagtcgtgaggtcatgaatcatggtaaaaagaatgcacttgagttagaaatgagaaagcctagtttagatgcttcgcttttacttactgaccagctgggttaacttgaccgtatcctttatccttcctgggcaattttcctaatgtgtaaattggaatgacatctatgctagctaattcataggtgttaattttattcatttctctaacaggcatattacctgacctacattcttcttcatttagtcggtgaagttagttgttctcattctttttcttctggacaacgggtaggtagtgtttagtgttgttgctgctgtttttaaataggtgttactgatgatggaatgagtgagcatgctttatataggagaaaactatgtaaacttttcttaatataaaagctaattgattttgctataagaattcccatgtataccagaaagaggggcatgataatggtcttgtaactatatcgtattgaaaagaattgttggccaggcgccatggctcacgcctgtaatcccaacactttgggaggccaaggtgcgtggatcacttgaggtcaggagttcaagaccagcctggccaacatggtgaaaccccatctctactaaaaatacaaaaaaattagccaggcgttgtggcaggtgcctgtaatcccagctgttcgggaggctgaggcaggagaatcgcttgaacccgggaggtggaggttgcagtgagccgagattgcgccactgcactccagcctgggcaacaagagtgaaactccatctcagaaaaaagaagaaaagaattgtcagcaaatgttaattctgtttgttggagtggaacttaaccattatactttggcagcagtataatatattcataagataccaacatcaccaaataccaaatgggctggtgttgtgctggacccatattgactccagtagaaatggcagtcaggtggcagcaggctacacaggagaactgctaccatctgtagagaccatgcagtttacatagcattttcacttagcaccctttacctagcaacctccatgtaaccaagaacaaagggcctgcatcccgtatggccttacaagggatgagccgggggttcagatgtccttcataggtaaggagtgaaactccatgttggccactcccagattatttggcttgggactccagttacacattcttcttagaccataggttcattttcagagtatgctttagttattgctgtcagatgcatctgccatacagccagcttttagctcgtttcttcccatttctttgccattccccttttgttcctttagaaataacatttgccttcaaaattaaactgatggtaaggcaggctgctttggaaatgcatttctaatattcagattttcattttgaattattcttcccatactcctggggaaagatcttgcttaattccttttatttcatatcttaactattccaattcctgttttaaaacttaggtcggacatgccgggcacggtggcacacccctgtaatcccagcactttgggagggtgcggtgggtggatcacttgaggtcagaagttcaagaccagcctggccagcatggtgaaaccccgtctctacagaaatacaaaaagttagccgggcgtgttggtgcgtgcatgtaatcccagccactcgggaggctgagacaggagaatcgcttgaacccaggaggcggaggttgcagtgaggcaagatcgtgccattgcactccagcctgggcaacagagcgagacttcatctcaaaaaaaaaaaccttaggctggacgtggtggctcatgcctgtaatcccagcactttgggaggccaaggcgggcggatcacttgaggtcagaagttcgagaccagcctggccaacatgatgaaaccctgtctctactaaaaatacaaaaaaaaaattagctgggcatggtggcagacacctgtaatcccagctactctggaggctgaagcaggagaactgcctgaacccaggaggtggaggttgcagtgagctgagatcacaccactatactccagcctgggcaacagagggagactccacctcaaaaaaaaaaaaaagaaaaaaatacatagtatctcctagacatgatagaaaagacacaagactaattcttatgtttttataaatgctgttgtatataaaactgtgtttgcggttgggcacagtggctcacacatgtaatcccagcactttgggaggctgaggcgggtggatcacctgagatcaggagttcgagaccagcctgaccaacatggtgaaaccctgtctctactaaaaatacaaaaattagccgggcgtgatggtgggcacctgtaatcccagctactggggagcctgaggcaggagaattgcttgaacccaggaggcgaaggttgcagtgagctgagatcacgccattgcacaccagcctgggcaacaggagcaaaattctgtctcaaaaacaaaaagtgtttgctcttctgattagaagctaatatagtcatctgtaatgttcttacatggtttttatattttatacattttttttttcgagacggagtcttgctctgtcacccaggctagagtgcactagcacaatcttggctcactgcaacctctgcctcccaggttcaagcgattctcctgcctcagcctcccaagtagctgggatcacaggcgcctgccaccacatccacacccagctaatttttgtatttttagtagagatggggtttcaccatgttgatcatgttgctctcgaactcctgaccttgtgatccgcccacctcggcctcccaaagtgctgggattacaggcctgatccaccatgccggctataaattactttttatgattaaaaaagtcagtgactgggcatggtggctcatgcctgtaatcccagcactttgggaggctgagtcaggaggatcacttgagcccaggagttcaagagcagcctgggcaatgccatctctgtttaaaaaaaaaaaaaatttagtgattattgtaaaacttatataaagtaaaacctgaaagactcctacaatccagtgccctcctgtaaatttcttcacaatttactaatatattacatataatatactaacaattattttaacaaaaatgtaatcatagtatcatttgcaacttcctttttttcctctttaaaaaaaaatttttttttctttttgagacagtcttgctctgtcacccaggctgaagtgcagtggcacgatctcagctcactgcaacctccgtctcttgggttcaagtgattctcctgcctcagcctcccgagtagctgggactagaggcatgtgccatgatgctggccaatttttgtatttttggtagagacggggtttcatcatgttggccaggctggtctcgaactcctgacctcaagtgatccacccgcctcagcctcccaaagtgctggtattacaggcgtgagccactgtgcccggcctcctctttaagacattagcacttggctgggcgcagtggctcacaactgtaatactagcactttggtaggccgaggcatgcagatcgcttgagcccaggagttcaagtccagcctaggcaacagagcagcatgccatctttacaaaaaaaaaaaaaattaaccgggcatggtgatgcatgcctgtagtcccaactacttgggaggctgaggcaggaggaacacctgagcctgaggaggttgaggctgccatgcactgtggtcatgccactgccctccagcctgggtgacagagtgagaccttgtctcaaaaaaatatataaaaaatcaaatatttgtacttctatctaataactatagtattttgaaacctttattgataaacagtatgttttttgtgattgcacatagtgttaatatgaacatgcttattcatatatctttgcccacttctgcaagcatagctataaggtaaattcctagaagtagaattgttagatcaaagtttataaatatttcaaattttaattattttaaatcgctattatcacattttcatcccagaaagtgttcatttacgttctcaccaagtatatgtgagagaactgcttaggtctatacatttctaaaatttaagatgcataatttttcaaagaattaagtatgaacctctattaatgaaaggttatcttgttcctatagaaaaaaaaataggccaggtgtggtggctcatgcctgtaatccaacacttggggaagcagagacaggaggattgcttgagcctaggagtttaaaaccagcttaggcaacatagcaagatgctgtctctacaaaaaaacaaaaactagctaagtgtggtggcacgtacctgtagtcccagctacccagaagactgactgagatgtgaagattacttgagcctatgagttcaaaggtgcagtgagctatgatcccaccattgcactccagcctggataacaaggcaagactctcttttttttttttttttgagatgaagtctcactctgtcacccaggctggagtgcagtggcacagtctcggctcactgaaagctctgcctcccgggtacacgccattctcctgccccagcctcccgagtagctgggactacaggtacccgccaccacgcccggctaatttttttgtatttttagtagagacgggttttcaccatgttagtgaggatggtcttgatctcctgaccttgtgatctgcccgcctcggcctcccaaagtgttggaattacaggtgtgagctacctcgcccggctgaccctatctcttaaaaaaaaaaaaagtcacaaactgattttgctataagaattcccatatataccagaaagaggggcatgatagtggtcttgtaatcatgtcatattgaaaacattatttgtcaacaaatgttagctctgtttgttggagtggaatttaaccattataccttggcagcagtataatacattcataagataccaacatcaccaaatatcaaatgggccagtgttgtgctagcgagtcgcagtggctcatgcttgtatctcaacacattgggagtctgaagtgggaggatcacttgaagccatgcatttgacactagccttggcaacaaagtgagaccctgtctccacaaaaaaaatttaaaaattaaaaaaatattggctgggcgcggtggctcacacctgtaatcccagcactttgggaggctgaggcaggtggatcacctgaggttaggagtttgagactagcctggccaacgtggcaaaacctgtctctactaaaaatataaaaattagctgggcatggtggtgcacacttgtaatcccagctactcaagaggctgaggcagagaatcgcctgaacctgggagccagaggttgtagtgagctgagatcgcaccactgcacttcaacctgggtgacagagcaagactctgtctcaaaaaaaaaaaaaaagaactgggcacggtggtgcatgcctgtaatcctagctaatcaggaggctgagactggaggagcacttgagctggggagttcaagggtgcagtgagctataattgtgccactgcactccagcctggcaccagagccagaccccatttctttaaaaaatttttttctttttttttttttaaaaggctagccgttgtctgaatattttgttagcgagtatgttaaaggaaggactctttaaatttctgagtactatattacccagttagagctctggggttaattttcattaatgcgagttaatgcatagcaaaacaacttttgttacagtgtgtattttttaaactagtaatcttattgtcatggaagcagctttcactgatacaactactgttacgttgaatagttaatatcagtcattgctaacaggaataatagatttttaaatgatttagttgttctagctgcataatttctttgttaatttgtaatgcttcagaattgttttcatcccttgcatttgttttgcacagaaacactttgtgctactctgtggggctttggaaaagcatgttaaatgtgatattagggaagatgcaagacttttttacagaactaaggtaagtgtgttctttctttttttctttttttttttcttaatcttggttacgttaatatttaaggatagaagcatacaggcctatattcagaaaaagaacatataaggctaggcatggtggctcatgcctgtaatcccaatactttgggaggctgagacaggaggattgcttgaagccaggagttcaagaccagcctgggcaacatagcaagactccatctctacaaaaatttttgaaaaatagccaggcatggtgtcatgcacctgtagttctggctacttgggaggctgaggcaggaggatcactggagcctaggagtttgaggttgcagtgagctatgaacacacatggcactccagcctgggagatagagtaggactctgtctcgaaaacaaaaagaaacatgtaagattagaaataggactttctcttttaataacagaaatcagctcctgctaaattagtgtagctaaattaaaagtgaaaggaaaaaaaatctcaaagcaaatacacttttcactttactttctgttctgaaactcctgacacccaaggagaaaaatacttctagtactaatgatacatatttttccccattacacaaattaaaaccttcatgcttaagttaccatcaaggattgaagcattatttaaataaatacgtaagttatgaaacagtggctttgaaattttatgatggttgaaaacttgttttattcatagagtacaaatagattagctgttattctttgaatgtttcattgaagaatatgttaaaggaaggagtcttcaatttttttttttttttttttttttttttttttttttttgagatggagtttcactcttgttgcctaggctggagtgcagtggcacaaattcgactcactgcaacccccgccttccaggttcaagcgattctcctgcctcaccctcccaagtaactgggattacaggcgcccgctaccatgcccggcaaatttttttttttttttgtatttttagtagagacggggtttcactgtgttgtccaggctagtctcgaactcctgacctcgtgatctgcctgcctcggcatcccaaagagctgggattagaggtgtgagccaccacacccagccaggagtcttcaaatctttgggtcgtacaacacctagtctgagctctagggtggaaatgatttcagcactaagcttgctaagctttttttcttaaaggttttatatactcaaagacagtagaaaagccaaatatatgagtatggagtaggaaaataatgttagtattaatagaatgatttgacagtttttcctgaaacataaaatcagacacttttaaaatacttttttctaaatacaaaaatgagccaggtgtggtggtgcgtgcctgtagtctcagctactcaggaggctgaggaaggagaatcccttgaacccaggaggcagagcttgcagtgagctgagatctcgacactgcactccagcctgggcgacagagcaagactctgtctcaaaaaataataataataaataaaacaaaataaaataaacatacttttttctaaagatttttttattccaagattatcttttagctttgataatgtaatacaatgctgattctttttgcctcttgtctttggatagtcattgaatgtgaagcctcagctttgtaacttaatatcttacattaattagctgcaaaggttagtcatttgaacaatgcccattcagatttaacatatgtatttattttagtaaatttaagttaaatacaaaaataagcaactaatgaagttatcagatttctgattttcaaatacatgtaggggatagctctttccccaagagtagaactctagtttcagaagcacattcttttgagcattcattgaccagaattgctggcctgtagaacttggtagtggctactactgacagccatgctaaaaggggaccacccaagttttatgtttcttaaagacaagggcttggcacagattgttgccagtgcttctcttacttaaagtggaaagcgacacagtggtctgtggaaattgcttcaagggatggtcctgctgaaatagatgagttgcctgcctctccaaaagcctctattatagaaaagttggtgattgttttggagaaatttgaactgtagatgaagaaaaaagcatagattgtagtttactttataaatttaaagctgctataaaattcctgacttgttgaaaacatgtttctcaagcagttatgttcaatagctaattgagaatctctagagtgatagagtttgggttttgtgttacagtttcagttgtgcacagacacttgctaaacctccaaatgtaggaaaatacgaggtatttaaaggggattcgtagtacttgggcacaagcatggagaggagtaacagtgaattttggatcttctaataatgtggagagggacaaataaacgttttttttatggctttgatcctttcaaagggaagctgggaagggaaggcacagaacagccaaagccttgggccctgttgacacagaccacccttcagcttctctatctggttgttcaaaagccagcgagttaaagttaagttcctttgaaggcagagaatgtgtttttggggatgatcttcaataacaggaaaattaaatcataagcattcaatagtttagattatgatgataaagggagtcttattaatttctatgatttgaaatctccttcaaaagatgagtagtttattttctctttgttgacagaaatcaaattgagttgttgagtgtgggcctgttgcagctgtcagatattttgtgtagtgttaagctgattgtaggtgagaatgttttaatctgatcccttttcctgtttttgatatttttaaggtgaaagacttggtcgccaggatacatggaaaatggcaggaaataatccagaactgtcggcctactcaggtgtcattttgttatacaatttcatgtattcttaatagttttgctgaatggcactcttcatactgtttgaaataaaatagggtataacagtgcacttgcttctagttatcttaagataaactgaaaacgccagtataatacatggtttgtaatttttttagttttcgtttgctttatattcattaatttatttccagaagtggttgagcccatttaaaaatattgcattgcatcaaatggaggttattcaattaagagcatttttaagacagatctattgagatagaattcacataccatagattttacccacttaacgtgtacagtggtttttattacattgacagagtgaataacatcaccatagtctaattttagaacattttcatcaccccaaaaagaaatcccatacccattagcagtcattcattcccctttcctctactaccttggttcccctcctgactcctcccaaatcctaggcaaacactaatctactttctgtccctatacatttccctattctggacatcggtaaatgagatatactatgtaatcttttgtaattggctgttttcagttaatataataataagtgaatccatgttatagcatgtacatcccttctattgccaaataattttccactgtatggatatgtcacatttatttatctacttatcagacatttgtattgttttcacattctggctattacaaataatatttccatgaacatttgtatgcaagtttttatgtgaatatgtgttctcaaatgaaacatttgaaaaggaagtcaaattgctgggccatatggtaattctatgttaagtgttttaagaaactaccagactgttttccaaagtgactgcatcattttatattcccaccagaatgtctgaggtttctaatttctccatattctcaccaacacttgtttttactaaagccatagtagggagtagggaagtagaatctcattgtggttttagtttgcatttccctaatgattaatggtgttaaacatcttctcatatgcctattggtcatttgtatagcttttttgcagaaatgtctattcagatcctttgcccatttttttcatcccatacttcatttcaaaaagcctatttttgaatatagttatttgtctttttattattgagttgtatgttctggatacaaatcccttattagagatataatttgtaaatattttcttccattctgtgtgttgcctttcctttatttttatttattatgtatatatttttgacacttttttttgatgttatatctaaggagtctttgcctaagagggacattttttttaacacctgctagtaagtgtgccagcctgcttgtttacagagtaactggcataggattgtctaaaatgacgcttctcaaattttaatgtacataggaatcaactaggaacttggtgaaatatggattctgactcataggtctggagtgagaactgagatattctgtacttctttttttttttttttttttttttttttttgagacggagtcttgctctgtcacccagcctggagtgcagtggtgcaatctcggctcactgcaagctctgcctcctgggttcacgccattctcctgcctcagcctcctcagtagctgggattacaggcgcctgccaccacacctggctaatttttttgtattttttagtagagacaggtttcaccgtgttagccaggatggtctggatctcctgacctcgtgatccgcccgcctcggcctgccagagtgctgggattacaggcatgagccaccgcgcctggctgatattctgtagttctagcaagttatcagattgatgccaatgctgctgcttcagggactaaactttgagtagccagggcctagaagttgcttatattttatatcaaaataataggaacactgaatgttaagtagataaagcaatctctctattttaagtctttgagaaatcttatatttatgttttgttgtttttgtatttgtttctaaccttaatagattttcttttaatgctggtcatgtactgatgtggtattaaaacagaaaataatttaatagcaaaactatactaatcagcttaacattatttaatctgcttaactaagcccctccatgtgtgcagtggtgagaaaaacatcctgcacttattttttactgttttttgttgtttgactactgaatgtgaaatttgaatctgattaccataaattttcagagaagtcaatataaagattttattacttgtcttatcaaagcccattgtctgatgattagtagttttataaggattaattcataatatgattaaattttgctttaccctcttttttctccttcccttttttaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccgtaagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatat

SEQ ID NO: 14049 - DNA, 934 bp, Homo sapiens
gactggtcttcccacctcagacgtccttactcagtccatcatctctttcaggattttcttctgtggtctttttcaaactactagctgacttttcccttttatttcccactaggaacccctccccgccccccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatc

SEQ ID NO: 14050 - DNA, 284 bp, Homo sapiens
tcacgcctgtaatcccagcactttgggaggccagggcgggcagatcacaaggtcaggagatcgagaccatcctggctaacacggtgaaaacccgtctctactaaaaatacaaaaaattagccaggcatggcagcgggtacctgtagtcccagctattcaggaggctgaggcaggagaatggcgtgaacccaggaggcggagcttgcagtgagccgggatcgtgccactgcactctagcctgggcaacagagcaagactctgtctcaaaaaaaaaaaaaaaaaaa

SEQ ID NO: 14051 - DNA, 3359 bp, Homo sapiens
aggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaaga

SEQ ID NO: 14052 - DNA, 52778 bp, Homo sapiens
  misc_feature (14610)..(14610): n equals a,t,g, or c
  misc_feature (14765)..(14765): n equals a,t,g, or c
  misc_feature (14785)..(14785): n equals a,t,g, or c
  misc_feature (14816)..(14816): n equals a,t,g, or c
  misc_feature (15045)..(15048): n equals a,t,g, or c
  misc_feature (15464)..(15464): n equals a,t,g, or c
  misc_feature (27637)..(27637): n equals a,t,g, or c
  misc_feature (27641)..(27641): n equals a,t,g, or c
  misc_feature (27720)..(27720): n equals a,t,g, or c
  misc_feature (27739)..(27739): n equals a,t,g, or c
  misc_feature (27750)..(27751): n equals a,t,g, or c
  misc_feature (27760)..(27761): n equals a,t,g, or c
  misc_feature (27790)..(27791): n equals a,t,g, or c
  misc_feature (27801)..(27802): n equals a,t,g, or c
  misc_feature (27825)..(27825): n equals a,t,g, or c
  misc_feature (27881)..(27881): n equals a,t,g, or c
  misc_feature (27898)..(27898): n equals a,t,g, or c
  misc_feature (49133)..(49133): n equals a,t,g, or c
  misc_feature (49143)..(49143): n equals a,t,g, or c
  misc_feature (49183)..(49183): n equals a,t,g, or c
  misc_feature (49259)..(49259): n equals a,t,g, or c
  misc_feature (51962)..(51962): n equals a,t,g, or c
  misc_feature (52734)..(52734): n equals a,t,g, or c
aggatggagagctgtggctggtttatgaagggttaaaacaagccaacaggttatatttgtctcctcaaaatggaatgttattaatttgttgtttttcttactaacagtgacctcctgactttcacccctgtatttcttgtgcattgattgtcttcttgggtaaattagtgttagtaattgtgttatttgttcaaagcttttcagtaaaactgagaacattcagccaaacaccttttttttttttcttttttagacggagtctcactctgttgcctaggctggagtgcagtggtgcgatctcagctcactgcaacctctgcctcctgggttcaagcaattgtcctgcctcagcctcctgagtagctgggattacaggcgtgcaccaacatgcctgactaattttctgtatttttagtagagacggggtttcaccatgttggccaggctggtctcgaactcctgacctcaggtgatgcgcccacctgagcctctcaaagtattgggattacaggcgtcagccaccacacccggtccaaacaccttctttaaaaaccttcactacaagatactattaaagctaaaattgaatggtggtgaatataagacacttcccttcagacactaaaatttgtgaatctctctctcccaggagttaaaagaaaaacataatctttcaattagggcacaaactattgggggagagattaagatttattactgagacagtggcttctcatatcctatagatagatctacaggatatatgtgtctatggcaatgtggctacatttttcttttcttttttttgacacagggtcttgctctgtcacccaggcttgagtgcagtagcatgatcacggcttaattcagccttgacctcctgggctcaaacgatcctcctgcctcagcctcctgagtaactgggactgtcacaagcatgtgccaccacactcagctaatttttttattttttgtagagacagggtttcacttggttgcccaggctggtgtcaaactcctgggctcaaacaatcctgcctcggcctcccaaagtgttgggattacagatttgaggtactgcgcccagcctaccttcttatatattattatcatgctgtctaaaagcaagatgaaatgcatgatttggcactctgtgtggttattatgaaattcacatttgtgaaacagcaaatcaggagagttttctgcattgctatagctcagaataattacccaaattcaacccgttaaatatgttcagaggagagaaaataaaattgaaacagcagcacctttctaacacagacattcatctgctctagtgatatttgtctttaaaatctcattaaaattctattttagtgattaaatttttaaaacactcaaatgtttgttcaaggggcttctgcttattctgctttgttctcatcattaacgcttgtcattaactttggggtgttattgctgcagatctttttgaaatgttttaatcactaaatatttttagtccactgttaacagtttgcttgcaatggcatcattaagttttacccagcagttggcaaccaagggactggaataaaagaatgtcttttctttcttcacattagttagttcttaaccataactttgcatttggaagagagtgactgtagaagcaggggtgcgtggcaaagggaggatgctctgactctggtgttctcactgccaatgcctggtctgctctgtgggcacagctggctgtatgtttgcttggaaaagcaataaccacttttttggtcctattaatatttgtgttctaaaaccacatcttgttaggattctgtttctgatatgtaagtttatgcggagagagaagatgacagatctaaaatatatataggaaatttcagaactatttgtgtggattcgggtaaatctgtatatataaggctggagtggtgttccagcctttctgtctttcagaataggagtagaatataattccctctgcctggaattagtaactgtagttctgaaggcacatttagttaatttggaagtttataatgttggcctttatagtgcagagttgttttgtggcaaaggtgtactgtctttgccaatttaaatgctaatttataaatgcaaatgcaaggcaaattaaagctgtttttttcaattgatttttttttttacatcctcatttcctatgaccctctttttttttttttgagacgaagttttgctcttgtttgttgcccaggctggagtgcaatggtgcaatctcagctcactgcaacctttgcctcctgggttcaaccagttctcctgcctcagcctcctgagtagctgggacaaaaggcatgccccaacacgcctgactaattttttgtatttttagtagagatggggtttcgctatgttggccaggctggtcttaaactcctcatctcaggtgatccgcctgcctcagcctcccaaagtgctgagattacaggcgtgagccaccacacccggcctcctatgaacctttcaagagaactaaaactctcctgtttcttagggcctctgagaactttatataatgcagaaagacacaaatgtgagagcacccgtttctatttctgcttcttgttttagtttcttgactttaatcaagtcagaagataacacagatactaaagaatatctgcttttcctactcttgcaagtgaacacgatgccttacacccgttaggcagcaactcggggtgtcgtctccccttccgacccatgtgtcctctccgcaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggtaaggagagctgccgggtccacatgcttcttaacctagcctgcccgacagtctagtttctttttgatcaaacacgggtttttcttgctgggaaaaactcacccctctgtacttgttacccctcttactccagcagagacagagtaaggaaaatacaaatattttggtaggaaggaagaaggcacaggttctctttatcacggagggctgcgtgctcttagacctgccctggaggcagacaaccacctgggtgcaggctgggcttttgatggcaggtgatctgcttcctccatttcagctgcagatcctctgccatcctaggtttattatgtgattgtcacaactgagactggggacaggcttcctttacctttggtccccaagcagccactgaggccatcccaggctccacctctagcagacaagtagggttagagttgaggttgagaaaggcggttggcaaaactaagccggggtttttggttgatgttggatggagctcccaggtcagggaggtgtgtgttaggattcaggtttacatattttctgttcttttaaacagaacttgtataacaagtgaggaaattgtctttttccttgtcagattctaaaccctggcatggagtctgactgttttcttttcttttttttgccttgttcctttttttttttcttttgccaaaaaaattttctaaaatatttctcagtcacataataacttttattactgatttacagttttttgacaaatatatttactatattaaaaatccttaaaaagtgataatttcatatttctatataaagtctatattgtagtgctagcccgattttgagaaaaattgtttaggattggtggtgatttgtgtcttttttaaattaacatttttaatgacctataataaaatagtatgaattttctctgaagatttaacaatctgaattatccctccattactccatttgtgataatttacattacaaacagttttctagtgtcatttattcaaccatcttttatatgaattagaagcaaaacgcaaaggtattctttttcacagtctgtctgtatgaggctccaccatgggaatgagggaggagggtgggggcagtgtgtgggctctttccaaagtgattgacatctcactaatttgtggggaaaattttctgaatcatgaaatattttttgaagtgttattttacaaagctcaagtatactgttgcttaaattaaactaacaatgctttgatgactaagtattaccaaatatactgaataatataataagttgattgattggcatacaagttctgtgctttaaattattgttttaaaatacaaggtgaaatcgtgaaataaagatgcttctgggtggcagatttccagggttttttcactaagttggtcagacatttctcttgcaaccttgtttgcaatattaatttttttggcaatttttcatagctaatacaaaaaatagactaagcccctatattctaagctaatagagcccagttaatgaatttgagtttggggaaaaccttttgtaggtcagctgcttctcctgccatcacactgactactaattcaggaggatggattcaaacataagtacaggaaatgatagactttttcaaaatcattgttttctcaatcttaattgtgcatttctataagaaacacttgagtaggatattaaagcccagcaggagacctgggcttagtgctcttgaaactctaccttgcccacctacctaccaccaacacaaaacacaaaaatgatttttctacctcatctagtgaacaggcttcacaggcctcccccgtgctgtctttcagcgaaggaagatgcacagcttcccaccagcctctccagcttcacaagctaacattgctattattctcacttttattatatttacctcccctattcttgccactgctgctggcggcaaaaaaaaaaaaaaaaagtgagcaagttgtgagcatcatgtgttggggaggctgggagtaaaaaggcaggatgttgtaggaggccaatgacagccttatctgggcctgctaagagatggcatcctggccacagcctctttcctttgttcacacaagaaacatctgtacatatgtaattagaataatctatactagaaagataaaagggtaatggaaggtgacaaatcagagcctttcaagtatatatagtttcactatttgtattttaaaatattttaaaattgattttgctgaaagatagcatttccctcaaacacacagacaaaaacaaatatccattgtgcctgttttttcagtattttgaggaattatatgcagatgaccctaagaagtatcaatcatatcggatttccctttacaaacggatgattgtatgtaaaaccatagtgcttttctgctgtcttcccttgctacttatagccctctgtaactgaagagcacactgctgcctgccccctcccaggaagtctcttcaaaattttcacgaaacctgtttctccccacagctgtcttttagccagtggtgtcacctctgtcagtgtcctgagtccattgtcacgtttggtttgttattaacactaggcttacagtgtgatggaagcaaaatgtgatttgaaaggtcacgtaaaatccaagaagtacaacttaacactttgaagagatagcaactgttccctttaatggttggcctagtagctaaatctactcctgtctaaactggaaaatgaatatttgtatttggaatgcctttcttctccataacctgaataacagaccacacacattgctgactcatagcccttctaagctgttactgagcctactgttgtccactttctttttgattgagtttttaaccatgtctgtcatttgagcaaattctttattaaatagccaataatcatggacttttttttaccttcctccttaagtgtactgcttttgtttctgtttttgcataaagcattcataaatacccctttcttctgtataagcaaaattatatcacctgcaagattttatagatgccttatgccacttgccactttggtcctaggtaagcagaccactctttatcctgttctttgtgattatttttttcaacttatcttttaattcccaaaacttctgaactattcttaagtttcagggctaattttagaatttcatagggtggctctcatagagacagtgcttcacacatggggagtgtcagttcctacctaagttcaaccattctttccacaaacctttttgtgcattcatcaaaatttatttttgcctagtcagtcctcctttaaaagaaagcattctactggaataccaatacattctacaaagcattcagttgattttcccacatggagtctactggaaagactctgcagtgagcctgctgtccatcacgctgtaaaggagtttactgcgttgtatattttaacatatggcttttattgtagctgcatttcccatgcctgccaattttagccaggtggtggctccaccaatgagctcttatgtaaaactaacgtgttgtttctgtgatattgtgtctattttcctttgatgcattttagaaggcctgtttcgatttttctaatatatttctctttttgatctttaggatttgatggaacaacttgaaaaacaggataagacggtccgtaaactgaaaaaacaactgaaagtatttgccaaaaaaattggcgaactagaaggtatttaaacctttttttcaagacggtcactgagtcttggtttgagtcttggcttaaagactaggctatataagtggcctaatagaggtttgcatgcaaatattagggataataacaaaatatgacttttggcaaacctaacctcttttgagtagaaatttacatttttaaatgaggaaaaatgttcttttcatgggtagtaataatttacagattttactctgtaagcatctaatgaatatcttctatatgccagacaatgtgctaggcagtatagcataggagttaagaatgtggattctggagtcaagcttcttgggttcaaatcttagctcttctacttattaatcatatgatattgggcaagtttctgaacctctgtatgcctgtgctttcccatctgttaaattagaaagataatagcatctatctgacatggtttataaggattgaatgagctattaggttggtccaaaggcaattacttttaatggcaggaactgcaaatgcctttgcatcaacctaataagtatattacacttagaaaagttactgacgcatagtaaaaatgcttcatgcgacttagttattagtcactatcattattcttagtattagggatactaagatgagtatgatagagtctgtcctcaaagaacttacagtctaatggaggaaaaatagagaagtaaaaaagaaaaatatgaattatgatgataaagaaataagatttttaaaaacatctcatgatttctatatgatgatgatgaaaaaattccttgagaaataaccaaatatcagttgttgttattatttatatacaaatggatcttatcttttctattagtgtgtttatgtgtttatttgttaagagttataggtacagggatctagcagtgaacaaggctaaagccaaactcctttttttttttttttttttttttttggagacagagtcttgctctgtcgctgaggctggagtgcagtggtgcaatctcggctcactgcaacctctgcttcccgggttcaagcaattctcctgcctcagcctcctgagtagctgggattacaggtgcatgccaccatgtccagctaatttttgtatttttagtagagacggggtttcaccatgttggccaggctgatctcgaactcctgagctcgtgatccatctgcctcagcctcccaaagtgctgggtataggcgtgagccaccgcttccagcctaaagccaaattttaagcttatttcaatgttctcactgcttaagggattttgagacagtctttggaatagccttcaaacctgtgtgaacggttaatcattttctctcattgtcattctgcatctaattcttgcttggttcaaacagtgaagattccccatcactgaggatgttcaaaagaatctatcatgattaactccaagtgtggttttcattcctccaacatgccaggtcttgtcataactgctccttctgtttggtcatcctgcttctcctggttaagtcctgctcagcctttgagaccagagtcatatgtcacatcctcaagagtagcctttcctgattacccagacagacgttatggttctgctctctgtgtaccacaatttggccgacatcttttatggtcttcactatgtcatatttttagcatttttctgttaaattactggctccataaagactctgagcttctgacatagaaaacattctgttccctttgctttcacagcacctagcatagtgtctgacctaatctataatcattccataaatgtttgttgagtgaatgagtaagtttcagaaatatttataacatggcaacatggacatttactttgtaaaggatattactctgttggatgtacaaatactgaaatatttgtttagaaatcagaaagattattttatagtcacactttatatataatcctttagcattacatgagtcatatattacattaaaatttgagcctccacatcacacactcacacacacatgagctataatgtctattagcagaacttaaaaatctttattcagagaactttttgcactttgcaccaattatatcatgagatgataatcagacagcagagtatttgtttgaaaaaaacagattttaagtgtattaacatgtgagattctttttttgttcaactcctaatgattcctttgccatactttagtaaattttgataaacagaaaagccattcattattttacataatttttattagttttctttgatatgtatattttttagttgaagagatgggttagactattttaagatattactaatcttaagccattgtcaatcagaaatcaacctcatcatttaaactatccagacagctgtaaagccataagtagcatttgagaatagcaattcatagatcaaacaaaaaaggcattataatagttcttaagaagagttacattttgagttaagtgatacatatctagaggatgaaatgaaatagatttatgtgacttgggcacttgctgagtgcagtgtacctgcttctaccccaaataaagagaatcaaggtgacacttttcatcctcgtatctgcctgttacacagaaaatacaggcaccttctaataactaaacgttgtcttatacttttctttaaatgtattgcaacacacttaaatccttttggtttaaaatagcacaactcttgcctcctcctacaagctacatttaattaaggaggctttttaaaaagccaacagacttttaaaaaaaatgctagcatatataatttttggcagaaactatatagctaaatggagagtgtttcaaaatttgatctgctttgtgctatattttcacccatcttaattttcatggaatcaagaaattaagacctgaaaggattctagaaatcaattagttatttcataagaggaaaaaactaaggcctgtaagtgacccatggttgcagcaggtgagatggcaggactagaacacataccttctaagggccactgatttctctcctttgtgtcaaattttcccacagaaatcttctacttattaggaattcatctgattgtctcaaacttgagatcaagatcttcctggtgccaaaagtaaatttttttaaaactttccaattttctttcctttttgaagacagaaaggttccctcaagtttataaagaatctagaaaatgaaactagagtcttttttcaggtcttcctagaagaatggatcattgggctcctcagtccctttgtgctgctataacaaagtacttgagactgggtgatttataaagaacagaaatttatttctcacagttctgaagggtcaagacactggcaagttcagagggtctggtttctgcttccgagatggcaggtgccttgttgctggatcctctgaaggggacgaactctgtgttcttacatggcagaaggtggaagggcaaaaggcttagctagttgcctctttatttatttatttattgagatggagtttggctttcatcactcaggctgcagtgcagtggcgtgatctcggctcactgcaacctctgcctcccaggttcaagcgattctcctgcctcagcctcccaagtagctgggattacaggcatgtaccaccatgcccggctaattttttgtatttttagtagagatggggtttctccatgttggtcagggtggtcttgaactcctgaactcaggtgatctgcctgccttggcctcccaaagtgctctgattataggtgtgagtcactgtgcccggccaacattttattttaattagtagataatattgcaaaatcaatcaaggttatgttgaactgacatctaaatttcatttgtgagctttgcaaagacttaagtccctagggagaattcagaggcagagagaaagtttttagtgagagtatggcacattctatctgacatttttatacagtaccaaaaatatcctggttagagattttgcaaaaggaaggtgaagcttccttttaaaacataaactttcttagtaaaaatatccattgtatttcacaaattctgagatgcagtgtttcccatttcaacatctctgaaattggggtgtatcttacaattgttgatgggttatagtttagttggcaatttttttagtgttacataaaatactgtatttcataaccgatagcatcatagatttgataaatcagtgggtttaaaatatgctctttgggttacatggagtccaaatatgtgcatttattgataaacctagtatgttgaacttgttttctcccagtttccccttttggaattgtacatgcggcttaaaagttactagtggcatagatggcaggggttttataattttgttttttacatgcagctgcaggtttatgatctgtagaggccactgtgtgctgcttcagaggtccttgtggtgttgtgtttaaactgacaccagaaattatgtaaaaccaaacagtttgagtctccttttctcttgcatggaagaatatactttagagttagtcccgtggctttcatactggatcatgcatatgaaaaactagattatgggagatggccgtagccctgatctgtccaatcacaatctgaccactctttagatatcatagtgttgctggatggtggtgacttcacctaaaccagattttcagcgctgatagtcccagtgtgtgctgctgcagcatgaggtggacggtgtgtcaccaggctccatgccacataagcaagagcactggcaggtactgatgttctctgtgataacctcttcctgtgggactggcttctcagaactaacccaggaaattacccagagtgacacaagaagcactactgacacctcgtggagtcagcaatattaagctttctaatgtttttgcatctgatctgcattttgtttgacagcaatctcagaactcaaacttaatctgcccttaaacaaatctcttaaccactctccctccctgtagataaaaggataaaaaacctggttactagcgtgtatctccacagtggctgtggtaactcatatgtccctttactttttgttggatttcccactcaagtctcaattttgagatgaaattggagacttttttttttaacctttagcataattctctagctgctgcccttgacaatagtgactatttttaacatctgaaagcattgtaaaccagtggttgtacttcattgattgcaactttataagtagaatttttaacattatattaaaaagaaataaaaaataataacatttaggaaatcatactacatagagatagtttatctgttcatgatttctctgggaatgaggatggcaggagaaaattaggtctttgccatatgaggcctttgtgaaaaataatacattttggaccaagtggtatgaagaaacactcttctaccagctatctgtatgtgttttgaattgattgtaatgatacatttaaagtaaatgttcttttgcttttaatggctaaagtcattgagccaagagcaagggggaattgtttctgctccttctgcccctttgtaggatattgattgttcctcctgtgaattaaagtcaaaatatgtttaaccatttctgattagtatcaattaattaacaaatctgttaaaccacttactttttggacatttaatcttattaaaaagtaagccttattacataaaaaaaagttttgagtcatgtaaggttatttgatgttaatttacagttaggcaggagtggctttcagagtaagatgaccatataattttgccatctgttcacccaattttaacagaaaaaaattattttaagagaaggcaattaagtggcaaatatggcaagtttcggttgttgtagaatgcattcaaaattataggaacttggagacctctcatgttttttatatggaaaacattttctcctcctttcttacttctcataaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctgggcaagtattttctgcattggataaaagttccttctggcacatgggttaatggtgggaaaaactagtcactaatttttgagatattcagcgtaggtttcattagtcatcatcagataccatgtattctagtgctgcagtagtgttctgaccacaccaagcactttcagtccaactgcagggacacatgcctcagacccacctacaaggattgctcaagatcaggtcttctcagccctggctgcacattagaatcacctggaagctttgaaccatactgatgtatctctctccctcttgcccagttaaatcaaaatctctagagagaagagcctggcaatgtctagtactttaaaaaaaaaaaaaagaaaaagaaaaaaccctcaaggccagcctcgggaaaatagcaagaccgcatctctccaaaaaaaaaaaaaaaaaaaaaaaaaattacccaggcgaggtggtacatgcctgtagtcctagctgctcaaaaggctgagatgggaggatcatgtaagcccaggagttcaagactacagtgagctgtgattataccactgcactccaccctgggctacacagcaagagtctttctcaaaaataataaaaagcttcttaagggattctcaagtgtaaccacagttgagcacaactgctctaggccgtttaggttcctgaatttcagtttttccttactcccctagaaaggtttgcaactaaataggtcaaggacggcagtgtaataatagggaagaaacaaaaaaaggaaaagattctaacaaaggaaggaatggacagaataaatgagatgagagtggaagaagcatttcagggcagcacactgcctttaagattgggtctgagcctgctggctttgcaagaaaactttttagagggtggtggtaaatgattagagtgtacacaccgtaagttgtgaagtgaaaatcctaaaaacctctcctttcagcctttgcacagcattcctcccgccaggtgccagggtgacagcagtgtgattggcacttatacctgatggaatgttcctggcattaaacttagtactatatatagttgcacaggtgcttaagtttcaacatgaatttcatttagcaaaaatgttaaggagccactggtttttaagcatagaattaacagatttatcaattcagcaaagaattaacagatttatcaattcagcaaatgtttaatgaactcttatcatgtgccaagcattttctaggtaatgagcaaagtgaagtacccagtcttacagagtttacattccaggggagaaataaagaaaataaaataaacaaatatatgatggagtaaaaagaataaagagtgaaggcaggtatactggtttgtgtaaaattgtcaggaaacactctttggtaaggtgatctttggacagacaccaaaggaagtaagctaacaagtcatgctaatatctgaggaaagaacattcaaggcagaaaaacagtaagcacgtaggcccagggcagggagcatacctggcatgtttaaccaacagcaaggagacccatttggagcagagtgagctggagtggggaaggggaatagggccagatcctatgctatggtgaggattttggcttttataaatgcttgacatggaggaagaccactccccattaattgcttcttcccccgccgcgcgggaggggtggttttaataaaaaaatacacacacccccccccacctattgtgggggtgtggtgaggaaaaaaaaaaaataaaataagcggcgcgggcgcggggggtttctttttttttttgttgttnaagataaatgtgggggcggcccccccccccctctgtgggggagaagggtggttgtttttttttggcgcgaccccccacccccacgaagaggagggggttttacccaccccctctcctgttttgttttttatttttcgggagaagaaaaaatattnttttgtgggggggcgcggcncaacaaacaaccgtgtgttggggggcccctntttgtctgccctcccccggggggggggcggggagggggaggaaaaatctctggcgggggggcgttgttttttttctcccccccccccccgcgggagggggacccccccttttttttaaaccccaaccctcctccctgatttgggagaacgcggcaaatttggcccccaattccccaaacctttaggggggggggttttttggggttttttaataaaaggggttcccccnnnnaaaatttttttgtttttttttaaaaaagggagttttttttcctttttttggggccaacccaaaatttctccccacgattcggaagagtgaccatgatctgtacctaacatttttccgaagagtaatggccactgattgttgtatggaaaatgcagtactggggagcaagagatgaattagggaggccagttagggagctattgcagcagcccagcaggagatgatggtggcctccatgggacatctgtagctggtagaagcagtgagaagtagctggattttggatgtattttgtagatagagccaacagggtttgttgatggattggatatgtggtatgagaaaagaaaggagtcaaaaatgaggaccccccctgtaaaaaagatactggaagactagacctgctatttatttantaagatgggaacaacttccaaaaaagtaggttccttagagaagcaagaatttggtttgggagaggcttagtttcatgtgcctgagcagagttgtcaagaaggtagttgatagtgagactggaattcaagggaaaagtcagcgcaggagatatcagtttgggagttgtcattatatggacatgctccacattccagaatttttctacttaaagagctattaaaatacactttttatattacctacttaccttgaatgattgaactcttacatgacaactgtgtttttatatctcacaatgcatgcctcgtgaaaattttccatgttatataaaattattattttttcttttttagaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaaggtcagttcctgttcaacaaaattctcatcatgaattgttaatgatgacagaatctgcactgattgatcttccttccttagagtttagctaagttgcttgttattaaaactttccaatttttatttacttacctatctattttgagacagggttttgctgtgtcacctaggctgaagtacagtagtgcaatctcagctgactgcagccccagtgcaatcccaggctcaagcaatcctctcagctcagcctcccaagtatctgagcccacagttgcacaccaccatgcccagctaattttttatgttttgtagagacagggtctcactatgttgcccaggctggtctccagttcctaggctcaagtgatcctcccccttcaacttcccaaaatactgagattacaggtgtgagccactgcacccagccactcagtcttgagtgaaaacttccactggaagaaacattcttccttgaacatgtctatctggcttctttcaaaacagggctcaagttgaacagtaatcaaaattaacttgacataactgcattttaattgtgcagtaaactaactttattcatggacagatatagtttgaggttttacttagaactaaacaatatttagtagagttcatatatacagggaacgtgatgctgaaattaaaatagatgttaaataagtttaagatatggctcattcatataaaaagatgtctgataaaacattacaatttttcttccaactttttctccacctcaccccataattttccctgttacctaaaatgcctggttccatgtgggaagcaacacacagatgctaatcagagaggaaagacttggaaaagacagccaagttatataactgagcagaaagcctacacaactcagtagtcactgagtcatcttgcataatccccctcttgactccagagaaacagtgagcacaggcttagttttaactcagtgttgctgtgaggagctaagatcatatgttccaggtactttgctttcggattatcaaacttaacgagagcttttagggtaaagataagtggatagtcaacatgccagtggactctttcaaatctaagacttcttttatgaacttaaaaaaaaattaggtaaaacatacataacataaaatttgccatattcaccatttttaagtgtacagttacgtggcattaagtgtgttcacattgttgcacagccatcaccatcatccatctccagagctttttcattctccccaactgaaacacagtacccattaaacactaactccccattcctccctccctcagccctggggagcgaacttttgataaatgctggttctctgttggtccctattgtgcaggtactttctgtagttaacattctacagtggttactaaagcatggagtttctaaagatttaacatttaaaaattgatgaatgtcttcccaacataattcattttatttttagtgtgttgatgcaatattgtacttagataaactataagttttgctacttcttaggccaactcctagagagagaaaaaactaaatcataaagttttctttctctcataataattgcaagaagatacttatctggtttgactattgtaccaaattctgtaaagattaaaaatgatgggcactagaactcatcactctttaattccatttaaaattaatgtgcttttgtctcaaaagcagaatttgaatcgtatgtttgtgcaggaaaaaagtatctagtttgtcagatcatttaatgccaaagtacggtgaatcgttgtgcgactcagcgttgcttactctctgggatagagtcggaactaacaaggatgtatttattttgatcaaatacagcttgcgtattgcaagaaactactacttggggaagctcaatgtagtaacctcttaggtaaagagatggcattctatgtcaattgtgtttcaatcgccaaagaagcaaatgttcttttattttgaagtaatatagagtatctcattttcatgtggacagaggatacccttagtgttcaaattgtatttgttgagttattttgtttaaaagtgggctgggtgctgtggctcacacctgtaatcccagcactttgggaggcagaggtgggaggattgcttgagcccaggagtttgagaccaaccctgacaacattgcgagaccctgtctctataaaacataaaaaaattagccaagcatggtggcatgttcctttagtcccagctacttgggaaggtgaggtaggaggatcgctcgagcctgtgaggtcaaagctgcagtgagccatgatcacgccactgcactccagcctgggcaagagtctctgtctcaaaaaaaaaaaaaaaaagtggggggcttagcaaagcctagagcccactaatgaaaacagatgctggattatttctagaatgaagtcttctccttaggttttaatcacctttatctggtaactcttcagtataggtgccgttacatccagctgggactattctgaggatctctgcagtttgacttgtgtagacgtcagtgaagacagtctagattggtgctttagtgacactctcccatagcccgacagtgaccagcacagtttcccaatctgcattcattgtctttgtcagcttagcccagagcatccactaggaacagttgtaatccagatttttggaagaggcagagttatttttagtcaaatctacacttaagctataggatgattttctgtgtttgggaaagtaataaaattgtatttactggcagtaaataatttatttaatttattttattcacaatcctcctacattggaagactatatacctaggtctttcagatatttacttagtggtaaagtcaggacctgaactcagtaattctgtctcagctgaaaagacttagttaggtttgatatcctctaggattttttttcttaaagtctttttaggggaatattctacaaaatttaagggcgttttgtactttcttaaaaaggtgattttatttacttaaaaaaaaatgatataatgagaaacccatctttccccatgatatatcctgtgcacttttactgcataaagccgctactaagaaaccaaaggcagatattctcatacagcttctaagaacctggattttgttgtgatatagtagtagagttattggaataaatgatttcatgcaaaaaaaaattagcttctaagaccatttgatggtaggcatccttccataggtaacttattgtggttttccttgcaaaggttttctgagaaaaagtgcaggcaaacattgatatttttgtgacttcccatatacaaactgggattagttcatccaaatggtttagtttacaaatgcatagtccttccaagtatgtctgccatgaagcccctgggaagtattcccagccctcacatctttttcaggcacaatgagtctctcttcttcctgccacggtggcccagtcctggtgaagagccaaccagctttcccctgactgtactgcccagctcaggacttccttcttctcatttctggattcacagctcagaaattttatcttacccttaacaagatttttaatctagtctgggtttaagtgcttcaaattctttttcatattctttatcacaatatttgttattcctctttctgcttttagttctgattcccatcattaaccccacgggggacatgaatttgggctagctgtagctgggtgatttttttttttttttttttttttttttttttttttttgagacagagtctcgttctgtctctaggctggagtgcagtggtgcaatcctggctcactacaatctccgcctcctggatttaagtgattctcctacctcagcatcccaagttgctgggattacaggcatatgccaccacacccagctaatttttgtatttttagtagagacggggtttcgccatgttggccaggctggtctccaactcctgaccccaggcaatccatctgcctcggcctcccaaagtgctgggattacaggtgtgagccaccgcgcccagccgggtgaatttttttctgcttaaaggagcagctaaattcgcatcagtttaattttctatgccaaaaaagtgaatggcaagcaaagcaacaaactgatgaacctggtcgctgacattctgctagcaatgacataagacttcacaactgtaatgtgatttatttttataattgtttataatggtaactgaaagaaatgggtcttttggtatctgttcaattttttttaggttgttatttccctaaggaaaaggcaagtttagacttattctctctttcagaaaagaggtgatgattttgaaaccgtctccttctggctctctaacacatgccgatttttgcactgcttgaaacagtacagtggagaagaggtgagaaaaccttgattacaaaaccagcatgctatactttctctgacctttttaaggaaaaaatgtaaaagcacaaaatgtttaaccatttatttaggaacccaaattcagaggtggcttggaagttcttgctttgtttgatgttcactatctatgaagcagtgatttggagaatgacagtttcttctttacattgtgagaaagcatagagaaaaataaaataagcattggtcagtgaatagttaccagaagtaaaactttttgtcagtatgttttagtgggcatttcaagagctaatatcagaatagtgaactatttaaagaaattaatcaattttggcttgccacaatacattaaaaggtgatcaaaaatcggggggagggatggcattgggagatatacctaatgttaaatgatgagttaatggatgcagcacaccaacatggcacatgtatgcatatgtaactaacctgcacattgtgcacatgtaccctaaaacttaaagtttaaaaaaaaaaaagaaaattttaatattaatactcttggacaataagaggaccttaaaatcctttaactctaaaaaaaaaaagggtgatcaaaaatcatgtctttcgatttgtccaaaaaaactctagtgtttttgtatgtagagacatgacctctcaaggaaaaaggtgaccaaaaatcatgtctttcgatttgcccaaaaaaactctattgtttttgttagaggggatatgttcattagctgtttgactgacttcaaatatttcaaaactatgtagaattttaataatgactattaagggctgctttagtatgtgtcaaacagcacttactgtatatggagttatttatgaacattaattcttacagcatctctgtgaggtaggaattatagtccagttttacagatgaggaagccaaggctcactggggctcattgatttacccaagttctcttggccacaaggagcagagctgggatcctgggtctggcaccgctgagggcccatgaccctagccaactgccctccatgcctcccatccctttgccaagagggcagcagagaaggtgcccagcggcacttactgagcactgacaggcagatgatgggaaacacagagatgagcaaggcctagtccctgagaagatggggccaacagaccagaatccctcagaggggtcgttgactgcatcctatcagtccccactttcggaccagtcattaagtaggtggtaaggaggcagatgcttggctgtagggagaatcctcagagtaagcacttgcctttatcacgtagcatcaggcaaacaacgtgttaaactgcaaagtgactggaagaagtgccgcccattcagttccattttaacagataccaccaaagattcccttctaacctctgactgaaaaccatggtgtgggtactacgaaatagagtaaagagaactttttgtatgtattcactagtctctgtagaaatcggtctatttcaagattatatatgtcctttgggtgtagtttttaagaataggactataaagaactgaagttaagagataatttagataatttagtgtttgacagtaaacctgctgtttcagaagtgaaacactctattttttttttttttttttttttttagttaagttcctccaatttgcttcattgacattgctattgggaagacttaaatgctaggttgccaagttaaggtattgttcaaaagctagtaagaactggagggggttatgatggaagcaaacaaacacacatcagcatttgagaatgtcagtcctggcattagtggggaagctccttggacagagcagaaaagagcatgaagatgctgatcaaattggagatagttaaactgaagagacaggttacttcatgtgtatcattaactttgccttatgactctagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattggtaaggccagggccccactgggcattgcagcctgcctatcattcatgcccatcgataagtagccaccagtggcacatgtttcagggcaggtattcatttggggagcataaagtagtaagatacagggctaaaattagccgaggaatcccagaaacccagccatagttaactgggatacatcgaaatcactgtttccacaagactgaaacagtagtatatggtttccttccctaatgtttactgtttaaattcagttgaatgcattgaattttaaaaaattgtcttaagttaccaaacattgttatcttccagcaaattatcagcaggctcccttttttttttttttgagacagagtctcgctctgtcgcccaggctggagtgcagtggcgcgatctcagctcactgcaagctctgcctcccgggttcacgccattctcctgcctcagcctcccgtgtagctgggactacaggtgcctgccaccacgcccagttaattttttgcatttttagtagagacggggtttcaccgtgttagccaggatggtctcaatctcctgaccttgtgagccactcacctcggcctcccaaagtgctgggattacaggtgtgagcccctgcacccagcctatcagcaggctcttaaggctacttccagctacactttctttccccatgcatgcattttccatgtttccacaacttcttcatttcccttctgtgggctcatagtgttccctttgctttcataggccacagttaactagctatttgagacatcaaaagctgaagaagccatgggagatggcaatgttttcttcagatgtcccttaaaacgtcattaaagcaccctaggttggcaaaaatttaggaggtaacacagataccaaggtcaacttcagccagtttttctattgctttgcctgtttctattggctgaataagaagttcgcctcaaagaagccccaatctaaatccttacccccatctcccagtcatttaacagcaacaacaaacatgccggttctagggaatctgtgtttagcacaattaaatagcaagatgaaccagacgtggcctttgctctcaaggggcttgctgtcagggagtggacatctcagaaacattctaagggaggcataagccaaatgctaagagagcacaacagggaagcagccgggccacaggtgagaagacgaattctgggagatggaggtcagcccaagggcccactgctgttgtgggaaacccagaataaggaagggcccagctctccagacccataccactcccctctcccacgttttctccaagatggttgtcagtgccctgcttttcttactgtttttgcctctggggctcagataacatggagaatgcttatcttaacccgaactgctacctaccactctcaaaagcccacccaagacacacacacttgttctatcacaaggctactgcttcttaacgcttcttattttagaaaagacaccattaagtttacttagattcatagtaaatttttgcaattaagaattattccttcagtaaagtttaaaatccggaagcccttttgtagtgaagttccttttccctctattttggcacccagatcatttttttcttttttgaaatggagtctctctctgtcacccagcctggagcccagatatgtggtctcagctcactgcagcctttgcctcccaagttcaagtgattgtcctgcctcagccttctgagtagctgggattacaggcacacgctaccacgcctggctaatttttgtattttcaatagagacggggtttccttatgttggccaggctggtcttgaactcctggcctccagtgatccacccacctcggcggcctcccaaagtgctgggattacagatgtgagccaccgtgcccagctaattttcctaagttgaatgtgcatgtgtttgtgcacatggatatgtgcacatgaaaggttcccttccacatcatctcctctaacaattgaaatactcctgcagtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtgagcaaatgccaacacctgcgacagtgtctttttgctgcccagctggcctgccagggttgtggagagctgatgacttgttttcagttcttgcatctcatgtctggtgccatgtggccaagcagcaagggagaaactggcacggagccactttcccttgcctggctggatttcaccacatctcattattgctccctgtctgtaccctgccaacaggttcttcacattcttgataggaaacccttttccactgtgaagcttgcttatttgggggagtgaagagatgatgcaaaaatacacaaagatgagatagctgcttcctctccttatgtgtgtgttttaattatacaataagaaattattaaattataataatgaagatttctaatgtttgattgctcttagaaatatatttttggaaaaatacctttttgtacctatggcaacaagaacaggtctgatagatcttttactaattcttaaaatatcccccctctatattttaagaaaagctgcacttaattttatgcccaatactcctcagcataacctcattattgtaacataatttttttgcaaatttttttttttttttttttttttgagatggagttttgctcttgttgcccaggctggagtgcaatggcgccatctcggctcactgcaacctctgcctcctgggttgaagcaattctcctgcctcagcctcccaagtagctgggattacaggcatgcaccaccacacccagctaatttttgtattttttgtagagacagggtttcaccatgttggccaggatggtctcaaactcctgacctcaggtgatccacctgtctcggcctcccaaaatgctgggattacaggtgtgagccaccgtgctgggccacaaattttttattttaaaacagctagaatattcaccaagaggagggaaaaatgatttctcctatcaaagtcttagtagttactcaatctcaggaactgttagtgttcttttcaaattttccatcctgacttacattgaagtgtagtgaattttaagacaataatgccttcctctcagatagtggagcatatttctctataagctctgcatggaaatgtggagccacctgtcgcaatattatgctggcccctatttgcctggttgctaagtgctgattgtgtgtctattgacctcagtcttaggactgctgccacttggttggctattttgtgaaacctacaatgtctttgtagtttgtctctgtcaccatttggagtctttgtctcttccagtggccctcccttgcctctctctcctttcatcccggagctttctcaggccaccatcttcatctcctaggctcttcccttaaggcttcagcacaggtatatgtggggcttttggttattcagttacctgatttggagtttgccttaagagagagtgcttcaaggattatcaagtctcaccctgcaacagcaacccagctctgaaattgtaagagaagctacaaagtgttttctggccagctccccaataaagacagagctacattatgttattctattttgtttattagcaagtctaataacttttgccataatgacttcatttccatcttccattaaagagaattacattatcttgtcatttagtcttatataatggtgattataatcctcatgactataataaatttttaagcacagctgatgagatttaagaaaattgaacaaaaatactgcctgtcattttaacataaatcctgacaaggccgcacacaaaaaaattaagacatttttgacaaaattcagcaaatttgcattctctgtatctcttttttttcataggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccaggtagagcaactttccctgttacaaaataatttaacattcatcaaagatgatctttagggaagtaaagaagtcctctacttattgcttgtatctctgagctgacttcatctgtgttcaagaagatatatgcctctaccaatcttaaagcaaggagattttgccagaaattaatacatttcagtgctaattacagtataaatatatttaatattcagcaaatatttattgagtacttacagtgttctatataacattgaaggcactgggatacacccataggcaaaacaaagtctctgctctcatggagtatacagtctatgcagcttatattccataaaatagctttctatcttatttgataattgagtggattatcaaatagtgactttgtttttagagacagataattcttgttacttcaacagatgattaattaagcctccatctcaaggcaccatatttattgctggggaagatgcttcaataaataaggaaaaattcctgccttcaaggagcttacagttcagtagggaagacagagtcgtatccaactgactctaccgtagaggttctagcaaattctgtagtaagatgcctaaaggaagtactgagggaagatagcagtattcagggaaggtcccattaatctgggcattgaatttaaggaagtggaagaatgagaagggcatttgaggattatagtgacagcatgaagcaaggcacaggcatgaacatgcccaattttcttttgcccggttattttctgtgctgactcttagactttctttcttgcctttttttttttttttttttggggacggagtctcgctgtgccgccagtttgggaggccangggnttgaactccactcactggaagctccccctcccaggttcacgccattctcctgcctactctcgggagaggctgggggganaagagggcccgggaaaaangggggggtaanntggattaannaaggattgggggggggcgcaaaaacccannaggggggcannaatttaagggctatacctccatngaccgaagcttacccccgccccccccttttttccaccccccccgcccgccttgttntcactttttcccccccnaaacacccccttcaaacacatcccgaaaatttgttcaagagaacctaagagtaatgggggcgaactggtggggaggaaagctattaatccaaagggcgcatgtggcagggtttgtatcaaagcgtcattggggagggccaataatgagggggaaaaaacatgttttgcggcaaaagggagcaacagggagggcaagggtctcacaaccaaagggaagggtgaaagggagaggcagacccaagtgtaaagggtggccagagagacacaggatgtcccctggaaaagggaaaagtaaaggtgtactttcaagggggacgtgggcaaaaaagcagggccatgggtgggcagggagttgcgggaggagtaagcccgatgacaggagactaccgtggggccgggagcccggcaagtaatttggcagagaacgacagcccccgccaatggtaggtagtgatctgcaagaagccaccctcggaggatagtggggatccgggggggggcagctgtcagtgggggtgccaagaggattatagagaaggcgatatgtccgtggcggaaaaggatatatgtgggacgggtgttgatgggggccaggtccagattatggttgcagttatatctgcagagataataaggagttcgggggttggtgggggtatagatgtcaacaagcataatcagggtgggatgtgcgggtttagcatgatctgggaccaaagcacggggagggggggaagccacaggatgaatttcctgcgacgtgggcatcttagaggcatattaggaatcgcggcagtgtgagaatgaaagtccaatgtctggggtttgccatgggtccaggatggtgccgatctcgggagctcatgatccacccgcctcagcctcccaaagtgttgggattacaggcgtgagccacagtgcccagccaactttcttaatgttcatcatatatcctacaacatatgaaattttcagttttgcccaatacaattaaaactcaatcagtttgagaccagcctgaccaacatggtgaaaccccatctctactaaaaatacaaaaattagccgggcatggtggcaggcacctgtaatcccagctactctggaggctgaggcaggagaattgctggaacctgggagacggaggttgcagtgagccaagattgcaccactgcactccagcctgggcaacagaaaaaatcagtaggccaggcgtgctggctcacacctgtaatcccagcactttgggaggctgaggcagacagatcacctgaggtcaggagttcaagaccagccaggccaacatggtgaaaccccatctctacaaaaatacaaaaattagccaggcattgtggcgggtgcctgtaatcccagctacttgggaggctgaggcaggagaatgacttgaacctgggaggcagaagtggcagtgagccaagattgtgccactgcacagagacttcatctcaaaaaaaaaaaaagtcaatcagtagacaatcagaatcaagacttgcagcttcttaatgttgaattcgtgtttgcataacttcttactaagaataaagcagaactatctgacagaacaatggtcctgagatttcctcccagtttctgcaagtgtggaaagtaagaataccctggaggaagcccaactttatagaagttggctgccattcaacttctaaagaatatactttaatacttaaatatactttaagcatatttcacagagtgaggcagacctgcagtttatttatttagcaaatattagttaacaaagtggtcccactttttaaaattcaaatacttgcctccgagagactgatccctaattcagtttgtcacccacagacctgataacaacatgcccactttctagttctctggtgcttaatttattttcctatagatcagcactgtcctgcattcaacttttattttcattttgtgttaatagccacatgtggctagtgactactactgttgtattggacagcacaggtttagacaataccttgaaaatggaaatatctaccttatatagacgatgatttattttcattagaaaagagacatgaccattttacaaaaaaaaattattgaactttttaaaaaagaacttcatactctctaattgattaatttctttaggggcttttgttattcatgttatttatgatcttttataaaaatatgatttaaaaaacattcaaaagagataattgtattaatacggctaacatttttatatggagaaaagttgcagaatagtattaatagaatgaatcccatttgtataaaaataaaatgaactagaatatttatagcagctagagggggtgttcaggacatggttaacaattgccactttgggagactggaaggatggaagtgcggacatttatttttcatgttttattctcttgtgctatttgaatatcttcgaaatttacacagcttcttacaatattacacaaacattacattgatacattctcttgtaaaaattcagataaaggtaaatgtgcagaccagctcctccttccttctggtcccagcccacccctgagtagaactgaaatctgtacgcacagatccttttaattttccagattataggtacccagtgtgtatttgataatatgccaaaaactttgatcatttcatttctcacagattgtgaaagtgttgaatttgtatactccagttaatgagtttgaagaaagagtctctgtgtcgttcattcgtactatacaggtaagagctcccatcttcttctttgattcaccaacacagtcttttgaatggacattttgtaatttattgaaggataatgtgttatcttttattatcttattttacaatgcactaacttttttgataatagttaattgggaaaatgaagtgagtttaaaacaaaagtaaacattcttcattagttgagaatttgagggtagaaattttagtagaaaaaagtcttttagattcaaagaactgatgctctgtttattttttttcctaatcttctcagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaacccttttgtactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaagagtttttgtcagtgtcttataagcaaatccactgcacattttaaaacaacaaaacaagttgttttcctgaagactagtgaatgtaaatataatccctccccatgagaatattctaagaagtcttggaaatttaaaagttgacgagttcccctcctatactggacaccctagtaatatatatgataaagaagagaactgccaaacacttaagcaaacagaaacagctgaagaagaggtagtgtcttttcttcaagggaaagtcatgcctaaatatattggaattctctgacagagaaatagacataaccaagggaaatttgatatgcataatctacttagattttcaaaagattgagggtgtcatttgtgtcaaaagttctacttttaatatagtgggacagtagacattttttggcataagacatagatcaaagaagtatgcagatgtgcttttttgggtaaggaaacagagcagttattcagatctgtggtggaattagtctcatctttatttatgataaggagaaattaatatcatcatgtaccacataacattttgggtcaacaatgcaccgcatatatgacagtggtcccataagtttataatactgtatttttactgggaccttctctatgtttagagaaacaggtacttaccattgcctgcaatttgcagtacagtaatgtgctatacaggtttatagcctgggagcaataagctattccatatagccagggtgtatagtaggctataccatctaggtttgtgtaagaacactctgatatttgcacaatgatgaaattgcctgatgatgcatttctcaggacatatcccctttgttagtaatgcatgactatgactgtacatggttttcatgtagattatacacttcctacttccatgacacattcattcaactcatttattaagtacttttctgggcaccgcaacaggcccttgaaatatagcatcttccaaattaaattcaatcactggccccatgaactacagcagaacaccaatatgttacaagtaataaaatgtcaaaatttgcaaacagtttctttttttcttttttatttttgagacaaagtctcgctctgtcgccaggctggagtggagtggcgtgatctcagctcactgcaacctccgcctcctgggttcaagtgattctgccacagcctcccgagtagctgctacaggcacccgccaccacgcccagctaatttttgtatttttaatagagacggggtttcaccatattggccaggatggtcccgatctcttgacctcgtgatccgcccgccttggccccccaaagtgctgggattacaggtgtgagccaccgtgctcagccaacagtttctttttctaaattaattggaaccaaggcaagattatttcccaataataaaatcacgctcatccagttgcattttggtatgatcattaggattctttctggggcatatgacaaaaatcaaactcaaactgacccaaccaagaaggaaatgtattacctaacacaattaaagttcagagatatatccaggtgcccaaacattgacatcagggatctccttttctttccttacttttggcttcattcttagtcatgttctccctcaagtgacaaagatggccctcagtagtgtttggcttcattctatggctctgccttcagtaattctcagtaaggcatttcaggatggagtctcagtggcttaagtcctacttccatcctcagaataatcactgtgtccagatgagtgctctgactgtcctagcctgacataccccccactgaaactaaaaattgggtaattcacagaaaacataggattgattaggtggtagtgggagttcaccagaggaaagacagagtatagttcacagaggaaatgaaagcaatgcatgtctacagtaatgcattctcctgaatgggaaagaaagggacacgaattgtgtgcagcactgggagtgtgccatccatgtgaaagtgtggagctgctgggtgggtttcctgggtcttagcagtcagcataagtgcacaaagaagtaagcaaagtgttacacaacaagaaatatgaaatcacatttaccaccccggaaagggacctgggaagacatgtgatttgttcacattgatcaccttgctactgaaaccaaaatatgatggacattattcaaaaggagagaaataaaacctgccatacagaccacgttagcaccatgttggccagctatgggcagttctggtcattgggtttcaaacaaaacacaagggaatataagaggttcagaagagaataagagataactgaaggaaaaggatactgggacctctagatctataatcaaaaaggaaaaggggcagtgctaaaaatagatggttagctagagcaagtttttgcctgaatccaggccattgggggcgaggcggtcagataagaggtaggagatcaatcccatctgggtcctctgttaacccgtaactcactaattaaacaaaatctaaacttagcgtggtggcgggcgcctgtagtcccagctactcaggaggctgaggcaggagaatggcatgaacctgggaggcggagcttgcagtgagccgagattgcgccactgcactccagcctgggcaacagagtgagactccatctcaaaataaaagaaaaaaaaattatgcttggcacagataaggaaaacatgaactacttaccaaaacttaaatatggtaaacagacattttgaaacttcagcagttactggaaaagaaagaaaatactagtttatgttgtcaaccatgtatatctgaagctcatttcctaagagtctatattatcaagaaagctaaatgaatttgaagagagtttggtcaatgctacttgtgaccaaaaaaaatttctactgagaagatctgggttgtatcaaatcttcaggttataatctaggaagacaaatggtttcttttcacatgtacacccatggtctgcgaaaaataggtctccgggctgaatggcctgtgtctaggatgaccctagctaggatggtgattactgtgcaaaagaatggggctccttttggagggaagtaagaagctgttaaaaacaacctcatgaaaacagaagggagggaggaaaatacaggtaggaatggggttggtcaacagaagtgagatgggcaaagaaagacaggccaaaagcccatggaaaaccattcttgagttgacattaaatacaacaggagaaatatttctcacatttcaaaagtagcttttaggaattccacttctgacatgatagcatgaggagctttgcagacaactcccaagggaaaccagtgaaaccagtgagaattattttaaaaacaaaccaaacccccaattctttaaagtctctagaaatggtcctaagggcatacaccaaatgaagaagtgcttattcaagaaaacatactaaagcttgataaagagaatgagcttgttgtatctgaaccaagattcctccctccttccatcttccaggtcaatgagacaaaaactccactctagactggtatagccaagaactcagggcttcctctctgccagctcacagttggagggctgtcttcctgggaggggcaggatgtcagcacttctcatcctgctcccagccacctcttgcttaagctaagtttcaaataaatgcagtcaacaggtggggggggtcccttctacccagcccctactcatggctcacaggctctaccttggggacatcactgctgaaaatactgggaccccagtgcatcttgttcaggcttttaaggtggtgctctcatcctgggaaaggccaaccaaaaagacctaaggccactatcccccatccaccgagcatttggctcccatcactcaaagagatgcaagccattgtcctcatccccagctccagaacaatggctcagagattttcaccaggagcagaagcaggctgtaaaacagaaagctccaaattacttcctaaaggaactgacttcatttgcaaaagagtgtggagaagttcaagcctaagggcgtttcaaaaacagtgaaggttgcagtgactggggattgggaggggattggtagattcattagagttatcggctgaactttaggctataactttcctggagagaactgggagaagagacagccaggaggagtccttgcaggatcagaacaagtctcaaacattgacctcaagaactatcctttcaaaggagcccaaaattgatcagatactgtctgtgaaacaatgtgttccttatagcattgttgaaaatcgtaattggtggagtttaacagctgaatgttaacacagtcaaagtgaagctagccaaaaccactgtcatcccaggtttagcaggctacactgcctgagaagcagcatcagaggcttcccactatggagtagtggaggagggccaaatagatcttattgaaataagccagctggtcactaaaacataaataagcccagtttatttacaaaaacaaggaccagtatgcagagctactacattatcagaaatatcttgattataaccaaaaaattacaagacatgcaaagaaacaggaaagtatgacttataagcagaaaaaaaaatcaggcaacagaaactgcttataagaataacaaggtgttagattaacaaagatttcagatcagccattataaatatattcaaagaactaaaggaaactatgattaaagaatacatttgatgaatgacaacaacaatacaaagaacaggagggaggaataggaaccttttgatattataaggtacttgtactgtaccttatacactgtaaagtgatatcatgttctgtgaagatgggcatggattcgttatcaatgtgtattgcaaactccagggcaaccactataaaaagtaaaaatagaagtgtaattaatatgctaagaaaagagaaaaaactgaatcacattaaatgctcaattaaaaccacaaatggcagaaaaaagagtggaagacaaaaaatagaaacaagaccaagggcaacaaatagaacagtaacaaatatggtagatattaatccaaatctatcagtagtctgtgtaaatgtccatggtctaagtacacaaattaaaagacagattgtcagagtggatcaaaacacaagacccaactatatgttgtctacaaggtgattctaaaattcaggtggaattgcaagggacaccaaatagccagaacactcttgaaaaacaatagcaaagttggatgactctaatttcaaggcttactacaaagcaacagcaaactagaccatctggcactgaaagtaaagatagacatagacatcagtggaatataatttagagtagggaaataaacctatgtgtttatgatcaattgatttcaacaagagtgccataaccattcgatggggaaagaatagtcttttcaacaaataatgttgacacaactgaatagctaatgcaaaataataaagttaggcctttatctcataccatatacaaaaaacaaacaaaactctgctggatgcagtggctcacatctataatcctagtgttttgggaggccaaggtacaaggatcacttgaggccaggagtttaaaactagccttggcaatgtagtgaccccatttctacaaaaaaaatttatctaggcatggtggcatgcacctgaagttctagatactacagaggccaaagagaagaatcacttgagcccaggaatttgaggctgcagtgagctatgatcataccactgtgctccagcctgggtaacagagagagaccttgtctcaaacaaacaaaacaaacaaaaactcaaaatgggtcacaggcctaaatgtaagagctaaaactataaaacttagaagaaaacaaaaggataaatcttcttgactttcgattgacaaagggattcttagatatgacaccaaaagcccaaataacaaaagaaaaaataaaccgaacttcattaccaatagcacatgaaaagatgcagatgcctggcatgagggaaatgcatatgaaagccacagtgagatactacttcacacccaccagaatgcctagaaccaaaaagtcaggtaataacatgaattggcaaggatgtggagaaatcagaactctcaggcactgctggtagaaatgtaaaatggtgcagccactctggaaaacaatctagtagttcccccaacagttaaagaacagagttaccctatgacccagcaattccactcctggaaatacccaagagaaatgaagacatatatgttcatacaaaaacttgtacataaatgtttatagcaacattactcctaatagccaaaaggtgggaacaacccaaatattcattaattgattaatataatggaatgttacttaatccctaaagaatcactgaaaagttaactcaagaaatagagttctttttaggggggaaatttaaattatgcacttaataaaaactatcaccaaaaaattcaagaaaggggaaacagagggagaaaaatacatgtgccatatagaaaacaacaaatggcagacataaatccaaccatatcaaagactacaagaaatgtgaatggattacacaccccaataaaaaggcagagattatcagactggatttaagaaaaacaaaaacaaacaacaacaacaacaaaaacaggcacagtggtgcatgcctgtaatcccagctacttgagaagctgaggaaggaagatcactagagtccaggggttcaagaccaacctgggcaactgttctgtgtgggagacctgcgaggggagaaggcacacacaatacttttaagggtaaacaactttatcccatgtaaatggcaatgcagataataataagcagatgatataataagcaaattgatataataagcaaattgcaatgggaaggggagaaaggataagatatatatatatatttacactcaccagactatggagaattcaccaccagacccgtaagcaacagcctgggctccagagtcggccactcactggtgtagatgaggagaggtctcatgaagcttcagtgcagtctgggacccaagctctttttgtaacaagttgtttggcatgaggcccaatcaggaggccctttgcgactgggctcaaggaacccaaaaagtcaacttttttttttgcaattgttgtttttcaataactaacgtataggaatagattgaaatggggatttctccaaaaaagtgctggatgaatgccttaaggggctcacacaacctattctgggacttggtgaccattgtttgtgtccatgttcaatttgatatttaacttttcctccacagcaacatagcaagactccatctctaaaaaaaaaaaaaaaaaaaaaaaaaaagaaaaagaaataaataaaatggccaggtgtcaggtgtggtggctcacgcctgtaatcccagcactttgggaggccgaggcgagatcacgccattgcactccagcctgggcaacaagagctaaactctgtctcaaaaaaaaaaaaaaaaaaaattccatatcctaaatgtcagagttctaactataacacatctagaagagaatctttatgagcttaagctaggcaaaaatttattagataacaacaccaaaagcatgatccacaaaattaaaaaatgataaattggacttcccccaaatttaaagtttttgtgctgcctaagacaccatgaagaaaatgaaaagacaatccatatagtgggagaaaatatttgcaaaccatatatcggtaaagggtttgtgatcaaaatgtttaaagatggtagattcaatacctgtatttactcaaccttcctcctgaaactccggtaagtaacaataaactcacaaaggaaaacagaatgaatgaggaatgacagcaacagcttggaagatgaaaaacagatggataaatgtcttttattttcacaagcaaagaaaactgaaacctaacccgggacaggcagaagcccagaagcaatccagtttgcactacataattccgaaaagctcaggaattaggttcagaggcagcaggtaacactgaaagtggcatgcagctgaaaacacaggaattggttgaaaatctgtttaaatagcagttcaagtggacttgaacagacatttcacaaaagagaataccaaagtggtcaatagtcatcatagaaataaatgcaacttggacccacagtgagacatcataacacactcatcagaaaggctattttttaaactgaccacatcaagtggtgaggatattaagcaactaaaagtctcacacactgctggtagaagtatacattgatataacaattttttacaaatctctttagcattatccgttaaagttgagcattacatacctgtgatccagcaattctgctctgtttatgtgcccaacaaaaatacatatatttgtgcatcaaaagacacatataaaatgttcatagcagcattattcatagtgggtgtaaactgaagcaaccgaaatatttatcaataggagaatgaataaattgtagaatatttatacaatggaatactactagacaggaatgaaagacctcaaaccgcagctacatgcaacaagatgaataaataccatgtaaaaagccaaatgcaagagttacacatgtgattccatttattaaaaacatccaaaacaggtaaaacgcatctatggtgatacaaatcagaacagtggttatctttgagagaaaatgatttgaagaaacagagaaagttttgggatatcggtaatgttctacgtctggatctgggcggtggttactttggtgtgttgatgtgttccatgaataagaatatattgagctgtacacttattatttgcacacttttctgtatataattttattcttcaataaaaattttctttaaataaaaaaggcagctagattctctttttaactctgagcaatcaggcagctgtcactactcaccttatagattttctttttctttatacaaaatagaattatttgggcaataatataaataattttgtatataaataaatgcaaaattaaatttaccatgatcctctctttgtggcatttatcattattgatccatgccaggcctctctttatattttttgatcccctttttgaaatctccgattccatttctctccctcataggtatccactcttgcatatttaatgaatgactttgtaatttatcctccttacctctattcacacatacttgtacccatgaacaatattcagtattgcagtttttgtgagtttttaaatattaaagacttgggctagacatctattcaacattgttttttatttctgagtcaagtagatcatgtctattcctactaacagctgtagagttttacatgtatatactatttctttttttatttttctctgctgtctgccatgtatatactattttatttattcccctattgatatttagatgcttccaactctttgataaataactatgttgtgatgaacatctacttaactgtctctttgggtgactgtgagaatttttctgcctacatttattttcataactattctcaaattgctctccaggatggcagtatattcccaccagttatgtaagcaaaaaaagtttttattttttttatttattttttttttttttttgagacggagtctcgctctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaagtttttattttctcacatcctaggcagtatctgagattgtctaacctaaatgtttttgccaatatgatgggtaaaaagcaatatctcattgttgttttcatttgtatttatctgattactgctaaagttgacatctccttgtatgctaacaagccatttaagtgtccccatctgtgaattgcctattaatttttgtcagttttaaaaattggatttcttttctttaaccgattaacaattcttctatatggaaactactataacccaacattttaaagatattatccctcttttattcctaataatttcccggttttaagttttaatcgtgaatccatctggagcttatttttggatgcagtgtttgccacggatctgcttttattgtttttccatataacgggcccatctaataaatattattttatttccctatctggtccttaaggctaccgtataatgtagggccctgctggggggctccagcatgttccattactcacgtatccgttctcacgcaagtgtcacactgttttaatgactactgctttgttatgtccctaaatatatggcaggacaaatctctcctctttgagaattgtcttagttatacagggcttttattctatatgaaatatagaatcattgtacaattctccaaaagttctgtaggattctgacgccaatatattaggcatatatattgatttgggtagaagtgacaccttgaccatattaaatattcccagccaggaaaatggcatgtctcccgtttacctgggccttcttttaagctctttaagagaattttaaacattttctccacaaaggccaagggcatttttgcgagtgtaatctctggatactttatattttcactaatattgtaaatatcttgtattgcatagacaatgctcatataaaggaccattacttatttttgtatttgattttgaatacgatgaccttgctggactcttaacacatttctttgtgttcagtacgttgattcccttgggtcttccatttaaatggtcgtatcctctgctctttgaggagctaacactcgggccgggcagcctccggatgcatctgttcctgcctggcagcgcgccccgggccccaaccttctccacccgcgctcccgccaggtgcagccgcccggccccggccaatggcagcgccgactagccgggccaagcttggagggaccaatcccgccgctgccccctcccctcgccgccaactcgggaacgggaacaggaggccgttggaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcaggtaggagggtccgctgggctcctgggagcgctgtgggggagccggccctgctaacgctgactcgacctggcgcccgggccacacctgccacacctgcgcacctgacacggcagggcgggcgggcgcgcgctgggggccgcggaggcgccgcggaggggccacggggaccggggacacgagcgagcgtcgcccctccatttaattatatattaaaataacaaatanttacctattnaaatcaacatataatcatataaatttaagataccaatgcnatacgacagcatataaattaaagattagatacaggatgagaataaaaatttaatagtgaaaaaaaaatagaatatnaaaggaaaaaataaagtaaacattgaaaggatgaatataatcgggcaacacggaggattacctcaacagcgctcaaatgcgttgtgaaaccctgcgggaggaaaacaagaaaaagggcagcacccccagcgccaatgcatggggacctaaaatccccagtgccaggggtcggggtgcgtccctatctcgcgggagtggagcgcctcggtcccttcataccacaccacgggtggaatcagagttgcccatgcgtacgtaggaagatgagacgacggccagtctcatggccccacctgggacccccttgaacgagctggcatagaagcttatgtcctcagtgttcgggctgctttctagaattctgtgtctacaaagtgcgtgaacgtgcatgtaggctcatcagaagctgaagcagcatgggtcacaggcttgagggcactgcagtggcaccaagcgcttggggagcccaggggccacgaggtgcagtcgtaggctctttgcctaacatctgtactgttagcaacagtacaaacaccacagtttctaaagcgcctttcatataccctgactctgggaaacactagagcattcctcagaagcttcctttctgctggctggggctccacctcttacctcggaagggcagcgttcccacatatgtcccaaaccctctgagatgggcttgggtaattatttggataaagagtgtgacagtgttagcacttttgaaaaaaaaaatccatttgaatagccataaagcctgatcctcctatacaccagttggggaaatctagagacctcagtattcagacgagtggaactagaatccatccatttccccggacacatgctctagctttctactttaaaagatgcttttgctgtagatagaaaagatagttatttaaaaaatcatgtttcaatggtttaagcaaacgtttttcttctactttgattacttagtaacagtccggacacaaagcaaccgaactgtagtttctcctctattgcatctccattaactggagttctaaatggacagtgtttgaattgccctagttttgttctagaatattttcaccagtgagactgtgagccctcagacagccaacagcgcttcttcagccttcagtttactggaagtgaaagaaaagtcttggactagtcttcgacgatactttggaggacagagaaaaatgctgctgctgaacctatttgaggtgacagtatttccagaagcagaaacacacaggtgcaagcacccctatttttaggtgcctcaaacctcagatatttattaaatgtctagtaagtaccaggcacaatgtaagaaaactgataggaaggagtttaaaggtacaagcttggagggaatgagaatctgagaatcccagagactgacgcagcctgatggccattcccactgaccttgtgtccacgtagacacctgtgttcctaggctgccacctcccttcctggtgggcagttagcccccattttgtctgttctggaggtgtgaaggggagggccatggcagccagagagcgaggtcagggctttattccccagtgtgggttttgagtgggggctggcagaatcaagggtggtgtgttaggactgttagatttgttatgtatgccagcagcgcccttgggctgtggaggagagaggccggggtcacgtagctgaattctcaggtctttccaaaagagaacaaagtacagatcctcctgcagtgcaatggcaagatcttgcctcacagaaacctccgcctctcgggttctagcgattctcctgcctcagcctcccaagtagctggggttagaggcatgcgccaccacgcccagctacttttgtatttttagtagagacggggtttctccatgttggtcaggctattctcaatctcccaatctcaggtgatccacccacctcggcctcccaaagtgctgggattacacacgtgagccaccgcgcctggccagaacttccttttgaagtaggctttctgcagctctaaaaaggagtttgacaaacaacttggagtagataatcagttctgagactctgtagtggccaattcttgataaatttggtaattcatgtacaattcttttggggggcatatattttgatatttgcctttaaagattaacattcattgttctgattatgaaagtaataggtacatattgtagaaaatacatccaactctcaggtgtctcttatgaggatcccattcctaatccattttaatgaagtaagcttcatgacgttagtaataaatattttcaatagcagacctggggtaggagctgtgtagcccgtggcaacaaggatgggtgtgggtgtgtgtgcctgagacaggcgtgtctgtgtgtttctttatgaggcctccatcgtcctatctgcacaagagtgtgtgtcactgcctgccaggtcattcttccattctcgttctctcaaaacttacacatccatgtcacgtttcggcaagcttctgctttttgctagctgttaaggattaaagcaactcaaatgatttaggggtagtcatgattgatatccatccagtgacttttctgttttattgattaagtaaggcgatttatattaactaatagataggttcctcatccagcattgtcctagtctagtacttgtaactgtgaactttgtttgtttgtttgtttgtttgttagnttttcttttttttttttcttttttcttttttttttttattgatcattcttgggtgtttctcgcaaaggggggatttggcagggtcacaggacaatagtggagggaaggtcagcagataaacaagtgaacagaggtctctggttttcctaggcagaggaccctgcggccttcctcagtgtttgtgtccctgggtacttgagattagggagtggtgatgactctcaacgagcatgctgccttcaagcatttgtttaacaaagcacatcttgcaccgcccttaatccatttaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacacggcaaccatccgatttctcaatcttttccccacctttcccccctttctattccacaaaactgccattgtcatcatggcccgttctcaatgagctgttgggcacacctcccagacggggtggtggccgggcagaggggctcctcacttcccagtaggggcggccgggcagaggcgcccctcacctcccggacggggcggctggccgggcggggggctgaccccccccacctccctcccggacggggcggctggccgggcggggggctgacccccacctccctcccagacgaggcggctggcctggcgggggctgaccccccacctccctcccggacggngcggctgccgggcggagacactcttctcctcccagacggggtgg

SEQ ID NO: 14053 - DNA, 175 bp, Homo sapiens
aggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtg

SEQ ID NO: 14054 - DNA, 117 bp, Homo sapiens
gctaatttttgtgtttttagtagagacagggtttcaccatgttggccaagctggtctccaactcctgacctcaggtgatccacccacctgggtctcccaaagtgctgggattacagg

SEQ ID NO: 14055 - DNA, 2403 bp, Homo sapiens
tccattttgtcggtagaggcagaaggagaaggtcggattgtagaagctggggtggccggcagctcgctcatcggtgttcgtgggctttgtcggtccgtgcctcgtctctccctggaaagggagggaggcttcaacgtcgagagggagccgctgccgcgttagttccgagcttgaagtcactaggacttctctcaaacttgagtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtagagagaggtataacattccagcccctcaatctagaaatgttagtaagaaccaacaacagcttaacagacagaagaccaaggaacagaattcccagatgaagattgttcataagaaaaaagaaagaggacatggttataactcatcagcaggtgcctggcaggccatgaaaaatggggggaagaacaaaaattttccaaataatcaaagttggaattctagcttatcaggtcccagcttactttttaaatctcaagctaaacagaactatgctggtgccaaatttagtgagccgccatcaccaagtgttcttcccaaaccaccaagccactgggtcctgtttcctttaatccttcagataaggaaataatgacatttcaacttaaaaccttacttaaagtacaggtataaaataagacaaatgtttaagtttagttatgttcacagatagttgtcaattggtctgaaacaaatttgctagggaatctatttgtgtagaactaattaatgtaaaaaaaatagacttcatctcgtgttgtgtgcactgtgatataatggtagtatcagtgcaacttaaactaatgattgtaattgatattaagtgttctcaactgagtaacttttaagtggaaaccaagtttagatttggggagtggtaaaggaatcagctttttctattgttaggggaagatagtaatttatcattcatggaccagtagattgttgaaagttggtgaatcggattataagcttctggctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgatctggcctcctcattcctgccaagcttgctttggggagttggataatgtgaaaattttaagtacctaggggagaaagagccatgtaaatatctgtaataaacttgtagcatatgtaaagttttcttggcctttatcttacaaaaatggaatattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagatttttggctttcacaatcttataacctaggatacaggtagtttcgagtatggtgccagtgatgttttgtttttgtttggtcaaggggtaggtgcaacccaatggaccacttatgcaaaagatgtaaactcttgcataatacatcgataacatgttttgccaactttaaatgcttaaacataagcgaaaccagtagcaagtatgtgggtcagtttaaaaattttgattgttaatgccctattttctaatttggcacctcttttgatgcctaagcaggtaagcagatgcctaagctgtatttctccaaataaatcaagaggaagtactgcccaagttaaatattgatagcctaaagacaaattcatgtagtacttaatgtacatgatatgaatttgaagcataaaattaaatttttccccattgaaaaaaaaaaaagtaaa

SEQ ID NO: 14056 - DNA, 1889 bp, Homo sapiens
ttgttcataagaaaaaagaaagagaccatgcttataactcatcagcaggtgcctggcaggccatgaaaaatggggggaagaacaaaaattttccaaataatcaaagttggaattctagcttatcaggtcccagcttactttttaaatctcaagctaaacagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaagtttagttatgttcacagatagttgtcaattggtctgaaacaaatttgctagggaatctatttgtgtagaactaattaatgtaaaaaaaatagacttcatctcgtgttgtgtgcactgtgatataatggtagtatcagtgcaacttaaactaatgattgtaattgatattaagtgttctcaactgagtaacttttaagtggaaaccaagtttagatttggggagtggtaaaggaatcagctttttctattgttaggggaagatagtaatttatcattcatggaccagtagattgttgaaagttggtgaatcggattataagcttctggctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgatctggcctcctcattcctgccaagcttgctttggggagttggataatgtgaaaattttaagtacctaggggagaaagagccatgtaaatatctgtaataaacttgtagcatatgtaaagttttcttggcctttatcttacaaaaatggaatattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagatttttggctttcacaatcttataacctaggatacaggtagtttcgagtatggtgccagtgatgttttgtttttgtttggtcaaggggtaggtgcaacccaatggaccacttatgcaaaagatgtaaactcttgcataatacatcgataacatgttttgccaactttaaatgcttaaacataagcgaaaccagtagcaagtatgtgggtcagtttaaaaattttgattgttaatgccctattttctaatttggcacctcttttgatgcctaagcaggtaagcagatgcctaagctgtatttctccaaataaatcaagaggaagtactgcccaagttaaatattgatagcctaaagacaaattcatgtagtacttaatgtacatgatatgaatttgaagcataaaattaaatttttccccattgaaaaaaaaaaaagtaaa

SEQ ID NO: 14057 - DNA, 744 bp, Homo sapiens
tattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagatttttggctttcacaatcttataacctaggatacaggtagtttcgagtatggtgccagtgatgttttgtttttgtttggtcaaggggtaggtgcaacccaatggaccacttatgcaaaagatgtaaactcttgcataatacatcgataacatgttttgccaactttaaatgcttaaacataagcgaaaccagtagcaagtatgtgggtcagtttaaaaattttgattgttaatgccctattttctaatttggcacctcttttgatgcctaagcaggtaagcagatgcctaagctgtatttctccaaataaatcaagaggaagtactgcccaagttaaatattgatagcctaaagacaaattcatgtagtacttaatgtacatgatatgaatttgaagcataaaattaaatttttccccattgaaaaaaaaaaaaagtaaa

SEQ ID NO: 14058 - DNA, 1628 bp, Homo sapiens; identical to SEQ ID NO: 7124

SEQ ID NO: 14059 - DNA, 1628 bp, Homo sapiens; identical to SEQ ID NO: 7124

SEQ ID NO: 14060 - DNA, 1628 bp, Homo sapiens; identical to SEQ ID NO: 7124

SEQ ID NO: 14061 - DNA, 1628 bp, Homo sapiens; identical to SEQ ID NO: 7124

SEQ ID NO: 14062 - DNA, 526 bp, Homo sapiens; identical to SEQ ID NO: 7125

SEQ ID NO: 14063 - DNA, 414 bp, Homo sapiens
agaacatctcaagataaaaagggaggaagaaataatgtgactagggattgcacttcctggagttgcaggtcacatgagggacacgaacatggtggtttgattaagtctcgcgggattataacactgttgtggccactctcactccattagtgcatctctccgcacatatcagatagcaaattatataatgataaagttattaaaatatctgtaaaagtcagcacaagctcaagggctcgacttggcctttctgcccactaagtggtttatttagctctctcatctcaaggccggttaatcttcatctatactttgttgtaaatcacccgctatgtggaacagccataactgcctgagttttaagatgcgcttctgttggtcgtccaacaaggctggtatcttaaagatgaatgc

SEQ ID NO: 14064 - DNA, 1644 bp, Homo sapiens
gtagccacacagcagcctcaatgctttgctgcttaagtatttcttccacaaatatcctagttcatccctcttaagttctgcattccattaagtcctaggacacagacacaatttcacccagctctttgcaaccttatattttataaatatggcctttactccagtttccaataccttgttcctcatttctatctgcagcctcatcagaatggcctttaccagcattctaccagcactctggtcacatacacttaagtaatcacttaagtaatctctacgaagatttagacttcccctagttctaaggtcttctttcagagccctcaccagaattgcccctaatggcagaaccgttcttggcaatgcaggcttttttctagcctgctcctccaaacttgttcagccttcacggttatacagttccaaagccacttacacactttcaggtatttgttgtagtaacaaccccacatcttggtaccaactttctgtcttagttcttttgttaaatgcctgagactgggtaatttataaagaaaataaatttaattcacagctgggcacagtggctcatgcctgtaatcccaccactttgggaggccaaggcaggcagatcacttgaggtcgggagttcgagagcaggctggccaacatggtgaaacccccatctctactaaaaatacaaaaaaaaaaaattagctgggcatggtggcacacacctgagtcctagttacccgggaggctgaggcaggagaatcgcttgagccggggaggtggaggttgcagtgagctgagatcatgttactgcactccagcctgggtgacagagtgagattctgtctcaaaaaaaaaaaaaaaaaaaaagaaagaaagaaaacaaaagaaatttatttcatatggttctggaggcagggaagtccaagagcatggtgctggcatctggtggggtccttgctgcattaacccaaggcagaaagcaaggggcacaagaaagcatgtgcaagagagcttgcttttataacaaaggcacttcaccaataacccactcacatgattatggcattaatccatttatgagggcagaatcctcatgacccgtttgctccctgcaaaggcctcatcaacaccaccacagtgggatctaagtttccaacatgtgaacttttgagggacataatcaaaccacagcacaagtatattagtttcctgtggctgttttaacaaataaccacaaacttggtggcttaaaacaacagaaatgtattctctcttagttctggaggccagaagtccaaaatcaaagtgttggcaagaccatacattctctgaagcctctaggggaggatacttccttatctcttccagccactggtggcattccttggcttgtgactgtatcagactgtatcattccaacttcttcttccctctttatatggcctcctttgtgtcatctcttttgtctaaggatacatgttactatatttagacccacccaggtaattcatgatgaactcaaaatccttcacttaattatagcttcaaaggcccttttccaaataaggtcacattcacagttctgggggtgaggaaatggttctggagccaccgttcaaactgctgtatctttgtacaaaagacagg

SEQ ID NO: 14065 - DNA, 414 bp, Homo sapiens; identical to SEQ ID NO: 14063

SEQ ID NO: 14066 - DNA, 1644 bp, Homo sapiens; identical to SEQ ID NO: 14064

SEQ ID NO: 14067 - DNA, 414 bp, Homo sapiens; identical to SEQ ID NO: 14063

SEQ ID NO: 14068 - DNA, 1644 bp, Homo sapiens; identical to SEQ ID NO: 14064

SEQ ID NO: 14069 - DNA, 5261 bp, Homo sapiens
gatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggagcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaagactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgagagag

SEQ ID NO: 14070 - DNA, 2054 bp, Homo sapiens
gtgcagctggacgctgaccacgactacccaccgggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcgtggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagctcctttgagagactgaggcaggaagattgcctaagcccaggaggccaagtctgcagtaagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctcaaaaaaaaaagaaaaaaaaattcaacattttattttgagaaatttcaaacctacaaaaagttgcaggaatagtgtctatctgaaatacatattcagtcttttctttagaagtcttttttttttttttttttttaaatagagcctcactctgtcacccaggctggagtgcagtggcgcgatctgtaaaatcactgtgagcactgacttagcacatactggaccgttgctcctaggagaaatacagggttgcgttcctgtgagctttggtcgtgatattttcatcagctgatcaatatgtaatcttgttttatgtgtatttctgtttaaagattcatatatatatgtgtatatatatatatggttgagttgttaccgttgaactcacagcccacaggactagaacacatgcctaaataaagtttatctaacatac

SEQ ID NO: 14071 - DNA, 285 bp, Homo sapiens
tttttttttttttttttttgagacggagtttcactcttgttgtccaggctggagtgcaatggtgcgatctcggctcacagcaatctccacctcccgggttcaagccattctcctgcctcagcctcctgagtagctgggattacaggcatacgccaccacgcctagctaattttgtatttttagtagagatggggtttctccatgttggtcaggctggtctcgaactccagacctcaggtgatccacccacctcggcctcccaaagtgctgggattataggtgtga

SEQ ID NO: 14072 - DNA, 14035 bp, Homo sapiens
gggcctcaccccagacaagcggttcctccctgggcacctgggcatgggacttgtggaaggtaagggaggacagagcttgcagtgggtagtgggtggtgtcgcccaagtccctgagggtctcaggtgggccctcactgagctcgactctctccctgcaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaagtaagtccttaaaagaaatacagaggggtctcactatgttgcccaggctggtcttgaactcctggcctcaagagatcttcccacctcagcctcccaaagtgtggggattacaggcgtgagccaccgcatctgggccagtcagagtttataaccctgccagattcatcctcaccagtggcctcctggcctggaggttttccacataccccttttctttggactttcttctctgggttcttttacaactctccatagagctttgtcagtatagaaacagtaatcggaacagtctccttcagttattctgaactattggctttagaaataccattctcttgattttaattatcttttttttttctgctttaattacatgacacattaattatcttgagttaggcaacaaagtcttttaaatcagtaaacccaagtgctggagtgtgatccatttgttttctggagcatttagaggtggatatttagcaagcagcatgtgtgtattttgttagaaatgatgtgttttctacctgtgatattatgatttataataagatatatatatttggacttcattttctgatacccttggaattttttaagtgctgtgtctgttgtatacaaatgagatgactagtggccaagggctcctgggtagccttgggatcggtctggttgtcagggaaccaaccctgtgattagaaggttgggactttgagtcccacccctacctcaggaagagcagaggggctggaggttgagttgatcacacgtggccagtgatttgtcaatcatgcctaagtaataaatcctccataaaatccccaaacaagggtcaggcacggtggctcacgcctgtaatcccagcactttgggaggccgaggcgggtagatcacaaggtcaggagttcaagaccagcctggccaacacagtgaaacccctttctctgctaaaaaaaaaaaaaaaaaatacaaaaattagccaggcatggtggtgcgtacctgtagtcccagctacctgggaggctgaggcaggagaactgcttgaacccggaaggtggaggttgcaatgagccgagattgccccactgcagtccagcttgggcaacagagtgagacttcttcaacaacaacaaaaacaaatcaaacaattgggtttggggcacatccaaatagctaaacaggtaaagactcctggagggtgggtgtttgggagagggcatggaagctaccccttccccacatcccttgccctgtgcattgcttccatctgggtattcacctggatcctttgtaattaacgggtaagcataagtaaagtgtttccctgagctctgtgagccactctattgagaatcaaaccaaggagggggtctgaggaaccccagtttatagccagtcagtcagaagcacaggtcacagcctgggatttgtgactgacatctgagggaatttggggcagcagtcttctgggactgagcccttaaccgttagatggatctccaggtgcatagtgtcagaattgaattgaattagaggatgtccaactggtgtgtggcgggagagttgcttggtgtatggggaaaactcccatacatctggtgtctgatgtgtgttgtgagactgtaatagaagataacagtttgttattttctgttctttagagtaccccatgccagttgtgaaaaggcaggcatgagctagtttagacttaatacagacagacactcctggagtttgtacatggaccctgtgcagttttactttttttttttgagatggagtttcgctcttgttgcccaggctagggtgcaatggcgtgatcttggctcaccacaacctctgcctcctgggttcaagcgattctcctgcctcagcctcctgagtagcttggattacaggcatgcgccaccatgcctggctaattttgtatttttagtagagacgggtttcaccatgttggtcaggctggtctcgaaattacaacctcaggtgatccgcccgcctcggcctgggattacaggcgtgagccaccacatttggcccagttttactttttaatgtgggctggtgacaagcagaagcatctgcctgtatctggactctcctcccaagagttggttcggcaccagggcccatggtgagctcagtcttctgtctgccgtctgttctctgcaggaggcctgcggctcactgaccagctggttctcaaggtcacgcctgttgtgtgcatgtaagagtgttgtaggtgcctttgcagcgattgctggctgatgggtgtctgtctttgccttttcttcagattggacgaggccttggcccagtactttgggaatgggacagagttggcccagcaagaagatatctacccagccatgccagagcccatcaggaagtgcccacagtgcaacaaggacatggtccttaagaccaagaagaatggcgggtgagtgcgctgccttctgcccccacctctgctccccagcacctgcggtgtcagccgtagctcgaaagaccctgccatttcactccatggaatctttcaagacaggcctgttgttgccaacctgcaggcaaggtgttggcctaaaagcatagcagggtgggatcaggcctttgaggtgtaaagcactatgggaattcagagcaggtgagaaactgaatgatagtggggtttttttgtcccctgtggataggacatcatatacccaatgtgtaacacatggaggagcatgagcttcagatctaggtgggtctgggttcaaatgccacttatgccgcatataagtggtgtggcctgaagcaagttacttacctgctctgaaccccaatttcttcttttataaaatgtcagtacttacaaggctgtgttaagggtgaggatttggtgaaaatggtcaggactatatagcacattgcctgatgtgttgtagatactcagcagatactacttttgttctctcctagttttagttctgaatggggcctgaaaatctcaactcccttttcgctttaaatatagtagatctgagtgggcaatttagcttcacatcaggttgttggagccagtggctggccactggaggaagttcacggggaaagacgaggtggaggggtggcagccatcattcatcaggtgccgtccctcactggtgtaatgcagggtggtgctctgtaagcattacctcatcccattctcctaactaccctgcaaggcagggatttttatgcagcttagagggctgaggtgcttgcttggagtcaagcagccgtggtgggcagcagagtttgaaaccgggttttcactgcctttttccatcctgcctggcccacctgggactgctgtgctccttgctgctgaataagaaaggaggtttctcaactcctcacctccagccatcattaacctggctggcccaagtgaagagaaggccacccaggctctcagaaacaagaggtctatgggccagacctggaagcaggtgtcagggctcgcgtcactcacagacagaagccagtgccactctaggcttagcccaatgactgggcgtatatttcagcacttaataaatgctgtcgatgggttttccttgctatcggtaggttattggattagtactcattggaatataaggagagagaataactacttttgttttagctctgaattctccaattctctgaattggagaattattattattctttagttattcgtttgttcttctgttattcttttgtaatgcttctctgagttactccagaaggtcaggagattatcttgtgggatttgccactccatgatttatctgttaatttccatttctgagattgtaaatttcttatttaaatgattggagttcggggcttttttttccttcatagtgtacccaggcacactcatgaggaatttgtaaatcacatgcatattagctagtcaaaccctaacgtttcatgactgcaaggtgttgaaaaacattggccaggagagaccgggatgggatggatgggcagtgggtggggtgtagatgttgcaggtgaggctttgtcacaaacagatgggtttccattcctggctcccatccacacatgcatgcatgtctctgggcaggtttccaggccacaccaagccactgtttactcacatgcaaactgagggggcccctgacactgcccagacttggcacgaggcagaaaggcaagaatgtgtgagtgcacagcacagagcccctggcgtcagcttggttggttgttggttttctaaatagaaagcagggccagcaatagctgctttgtgcttttgggatgtgagaaggctcatttttcccaatcaattcaatatgagtgcttgtgtatccagttaagtgtcatccagaaaagggaatgttgtcctcgggcagctgaggaaaggctgccttagctgatggccaacagcggagagcatctcctgcactcctatcatctgacatggcactttgtccccaggttctacctcagctgcatgggtttcccagagtgtcgctcagctgtgtggcttcctgactcggtgctggaggccagcagggacagcagtgtgtgtccagtttgtcagccacaccctgtgtacaggtgagctgggcacctgagtcaggtgcctcctctggagtgtgtacaccatctttcccttgctcctgccagaacccagagaggagtgtcggggattccactcaggccctgcaggggcgtagctgtgttctgcagcagccagttcagcagggctggtccagttctgttgtgttccatgctgtcactgctttggcaggtatgaccctgtttggagtgggccatgggcaaagaaccatgaagggctctttccctgccctctccagatagatgattgctacaccaggcttaggaaattattcacatattaaatacaacatccaagcttgggctacgtagcaagaccccatctctttaaaaaaaaaaatttttatttaaaaaaaaattttttttaagacagtctcgctgggttgcccaggctgaagtgcagtggcgcagtcttgactcactgcaacctccgccttctgggttgaagtgattcttctgcctcagcgtcctgagtagctgggattacaggcatgcaccactatgcctgaccactttttgtatttttagtagagacagggtttcaccatgttggccaggctggtctcgaactcctggccccaagtgatccacccaccttggcctcccaaagtgctgggattatagatgtgagccactgcacctggccaaaaaaaattttaaattagccagatgtggtgacatatgcctataggccaagctggtcaggaggctgaggcaggaggatcgcttgatcctagaggtctaggctgtagtgagccatgatttcaccactgctctccagcctggaatgacagagccagaccctgtctctagaaataaatgaataggccgagcctggtggctcaggcctgtaatcccagcattttgggaggccgagacaggcggatcacgaggacaggagatcgagaccatcctggctaacatggtgagacactgtctctactaaaaatacaaaaaatggccaggcgtggtggctcacgcctgtaatcccaacactttgggaggccgaggtgggtggatcacgaggtcaggagatcgagaccatcctggctaacatggtgaaaccccgtctctactaaaaatacaaaaaatcagccaggcgtactggtgggcgcctgtagtcccagctactcggcaggctgaggcaggagaatggcgtgaacccaggaggcagaactttcagtgagccgagattgcaccactgcacaccagcctgggcgacagaatgatactctgtctcaaaaaaaaaaattttaataatttatttctagtaaatgcattgcatactactgtaaataacttgttttttagggtaataaaatacctattttcaaaagcaaaataataatgacattaatgacattgttttacattttgcaatttgtatgtctggcttaatagaagagagctggattcccgtatctgcttctgcagtcagcctgctgagtcattgcatgtgctggaacctccaggaaactccgttgtatacacatggaagaataagagcaaaatagacataacctcttagaattttttttgagacagagtcttgctctgtcaccaggctggagtgcagtggcacaatcttggctcactgcaacctctgactcccaggttcaagaggttctcctgcctcagcctcccgagtagctgggactacaggcgcgtgccaccatgcccagctaatttttgtatttttggtagagatggggtttcaccatgttggtcaggatggtctcaatctcttgattttgtgatccgcccgcctcagcctcccaaagtgctgggattacaggtttgagccaccacacctggcctataaaagagttttgcactctccttgaaagggctcaggcaccctggaaccacacttggagaactgctgatacagagacatgggacttctcagaggtgtttttattttagtgaattactgggatcttagatttcatctgcactgtttcccactgtccactcctgtgatgactggtgggggcttgtggtgggctgatagagggcctcacaggggacttgtgtgggcttcctgatgcataaggaatggtggagagaggcctagggctaaagcagccctcactggactaaggagaagctggcatctggttgttaatgttttttctcatcttctggcctcactaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccaggtgaggcagggaggggcatgggaatccctgccttcagttttcaggtgtttacctcagagactggggacagcagaaagaaggcaaggcagggtcatggtgggattgggaggggcacctgggctgccttgcacctcacttttcctcacttgatcactttcagcaaggtgataattgtacagtcctcattccaaattaaagggtagctaccagtaatggtgtcacttgccctatgcctggcactatgctaagtatacttcctgtgcatcttccatcctcattgggtaagcattatgatcacaattttacttataagtgagaaaggtgagacccagacacatgaagtgggtattgctcagggtcccatagcaacagacaccaggatgagtacataggccttcccagtcccatggccatgtgcccttgcagctgtcgtgacccttggcagaccataagcatcagcctcatttctttttttttttttttttttttggagactgagttttgctcttgttgcccagactggagtgcaatggtgcaatcttggttcactgcaacttccacctcccaggttcaaatgattctcctgcctcagcctcccaggtagctgggattacaggcatgcaccaccacgcacagctaattttgtatttttagtagagacgggggtttcaccctgttggttaggctggtctcgaactccacctcaggtgatccacctgccttggcctctcaaagtgctgggattacaggcgtgagccaccgtgcctggcccagcctcatttcttcagatgaagatgccaaccccgatgatatttaggaacctgcccagggtgacacagcttgggccaatgtccgggaactgggtgtcatgagaagtggcacctggacattgcatcaagttgaatggtgtacgtggaggcactttgaatggttcctcctgctccagtgcacaacagagcttaagtagctgagaatgacccaaaggcctagtgggagctttggagttgagcaaatctggttccaaagctcagcagtataaccttgaacaaatgacttagcctctctgcctcaagtttgctcaacaagatggtccctgcctacattcatagggttcctgttttagaaaggagtttagtctcagactatgattcttacacatgtgtcactagcccggcatgcacagaaagaaaccagaggtttggtaaaaactgtgggacttggaactggctaccagtgctaatggggcccagagatggccattgcagtgagagacccacatttgaagtgagatgcagtctggcctcttgtctccccacttggaaggacatggtatctgacctccaggctggctgactgactgtcctgggtaaatgagcagctggtctggaaaggcctgttgaggggacaggaagggatccagagctggactttcctgcatggaggtgggccgcaggttgccggtcataggctgcttgtctttcccaccctaccacacaggccagcttgcttgggtttctgcctctgtaaaaagggccggcatgaaagtccacttaccaagtgagtgtgggacaatgtctccaaagcttaggattcttgagggagaggtgtcaggtaacataaggcagcaggcacatcgcacctcaaccttacagagttggacacagtgtgaagggaggctggctggtggggtgtacatggctgtataaaaactgattcagccggtcgggcgcggtggctcatgcctgtaatcccagcactttgggaggccgaggcgggtggatcacgaggtcaggagatcgagaccatcctggctaacacagtgaaaccccgtctctactaaaaatacaaacaattagccgggcatggtggtcggtccctgtagtcccagctactctcgggaggctgagacaggacaatggcgtgaacccgggaggcggacttgcagtgagccaagattgcaccactgcattccagcctaggcgacagagccagactccacctcaaaaaaaaaaggccgggcacggtggctcacgcctgtaatcccagcacttcgggaggccaaggcgggcggatcacaaggttaggagatcgagaccatcctggctaacatgatgaaacccgtctctactaaaaatacaaaaaataaagtagccgggcgtggtggcgggtgcctgtagtcccagctactcgggaggctgaggcaggagaatggcgtgaacccgggaggtggagcttgcagtgagtggagatcacgccactgcactccacactccagcctgggtgacagagcgaagactccatctcaaaaaaaaaaaaaaaaaaaaaaaaagtgggtcaaccctatcggctgccgccctttttttttttttttttttttttgagacagggtcttgctctgttgcccaggctggagtgcagtggtgtgatcacagctcactgtagcctcccaggctcaggcatcctcccgagtagctgtgaccacaggcatacaccacacctggctaatttttgcattttttaaagacaaggtttcaccatgttgcccaggctgatcttgaactcctgggctcaagcaatcctcctccctcagcttcctaaagtgctgggattacaggcatgagccaccgtgttcaggacttgccacttctgcatgtcagttctaacctcacccctcccctgactctcccgacagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaaaaaaaaaaatgaaatcctaccatacatgacatcctgtgtctggtttctttgacttggctgatgtttgtcaggctcatccacattgtagcatgtcagtcctcgatgtttatgataagctgatagcccactgtatgaatataccacacgattatccatttgtcagttgatggacattgggttgtttccactttttggctattgtgaatagcactgttgtgaacattggtgtatgagtgtctgatgacttgttttcagttattttgggcatatgccgaggaatggaattgtagttttataccataactccatgttttgactttttgaggaacctacaaattttccacagtggatgcaccactttacacccaccagcagcacaccagggttactgcttctccatatccttgtgaacacttgttcctttccttttcttgtattatagccatcctagtgttttgtcatcctagtgggtatgaagtggcgtgtcattgtggttttgttttgcattttcctagtcattaatgacattgaccatctttccacaggcttactggccattggtatacattctttggagaatgtcgatttaagttcttcacccattttttattttttattttttatttttttttgagatggagtttcgctcttgtgcccaggctggagtgcagtggtgcgatcttggctcactgcaacctctgcctcctgggttcaagcagttctcctgcctcagcctcccaagtagctggaattacaggcatctgcctccacacccagctaatttgtttagtatttttagtaaagacggggtttcaccatgttggccaggctggtctcaaactcgtgacctcaggtgatctaccagcctcggcctcccaaagtgctaggattaacaggcaggagccatcacacctggtctcttcccccatttttaaattgtgttgtctgtctttgttgttgagttgtaggagttcttaatagtttctggatatcagatgcctttgtggttttcacatctctgcaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaa

SEQ ID NO: 14073 - DNA, 114 bp, Homo sapiens
tttttgtatttttagtagagacggggtttcaccgtgttagccaggatggtcttgatctcctgacctcgtgatctgcccgcttcggcttcccaaattgctgggattacaggcgtg

SEQ ID NO: 14074 - DNA, 1307 bp, Homo sapiens
gctgagactaggcactggccaggctgtcacctacagtggtttcaacctcctgctgccagcaagacagcatctcctgtcctttttgtgcaggaaccatagctctgttgggttaagtgttttcctctaccaagcagctaacctggccttgaaacctaatctctgatgccatgtccccccaagccccatcagagttttgtaaaaagcccctccctgctctccacaccaatgctgagagcccatggggtaactggaggcttccctgccatcttggcaaagaagcctggctgacgtcctgcacatgcttccccaggtgattgcttgcacttaacagcagaggaaacgagaccaccccacacaacttgtagcagttgaggagtctctgcctgatcccaccccggatacttagagcatccagaattaaaaataagccttgtcaccaacatccggctcccccactccccagagccaggctcaatgtgcccaacagcgctggggcccgcacctggaggcactggcttttgagacactgggcagagaccccactgccctttgggatgaattcaccacctgcctcttatagaatccggccgaagacctgggatgttcacattcagctggatctccaggtttcttggactggaacacaggtggccccagctcaatatgctcaccagggtgttgccactcacctgttgaccgtccctaccagggacagatctgtgcaccccatccccaccttagaccaccagctcacacacaggtggtgttggtgcagtggttaatgttaggtgtcaacttcactagattaagggatgccgagatggctggtattttttctgggtgtctgtaagggtgttgccagaggagagtgacatgactcggtggactgagaaaggaagacctaccctcaatgtgggtgggtaccatccaatcagctgccagcacggccagaacaacaggtggaagaagggggatgagcaccttgctgagtcttctccagccctctccctcttccgtgccagatgcttgcttcctcttctctgctgttggacatcagactccaggttcttcggcatttggactctgggacttgcaccagcagcttcctggagccttctgccacagactgaaggctgcactgtgggctttctggttttgaggcttttggacttggactcagctatgctaccggcttctttccacagcttgtagatggcctattctgggacttcaccttgtaatcctgtgagccacttctccctaattaactcgctttctatatattacatacagcctattggttctgt

SEQ ID NO: 14075 - DNA, 22635 bp, Homo sapiens
gttcctgacgtcagtcgaaatggagatccgtttgtagctacctccatcgtggaagcgattgcgactgttgacagagctataaactcaacccgaacacatttgtttgacaggtatcgtggggctgtaaacacgctgaccctcaaatcactgagctttagggtgaaggtgggagtgattaaagaatgcatgcagttctaatatatgaattttgatttgattatctgatgatcaaaatgtttaatttaaaaatcatgaacaacatgggcatctgagttttctgggggttgaaataacagaaggatgtgtgcttttcaaatagaatttggctatgatccacaaccaaaacattctttgaaaatttcaactcattcctttggcttatgactaaatgatttggcaaaaacaaatagtttaaaagtcattagtgtatttgttcacgttgctgattccaaagcagtttttctgcatcttatgtgaaatgcaatatctgtgattttctctattgacttaattaattatttgtttttagtgtcttccggtttttgtctgtttgttttgtttttgttttgttgcctcccacttcggatgaggaaggtatagtacattatgttgtagaaagtagccgtagaaatattaatagcaatgattatattttggggtactatgaattttatcttcagtaatttgtttcattcttcctttcttccccctaaactctggttagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctagggaagagttccagcattttctttcccactgtgcttatgaactgtgaaattatttccttaaactgtgattcctcttgagccctacagccctgtcgctctcactttggtttaataggaatctctgggggacgtgaagtcccttggagtgctgatcaggctacagcaggtccacctgccctgagtgggttatgccatcctggccagggtgggttatgcaagcccagtccctctgcaacaaatgagccataagggaggacttggcagcgtgcttgctccctgagtgacgttgtgtcctgggaatgcggtgccacgcgtattaggagggttgttttggaagagtcccgggtctgtgaaaccagctgatgagatcacctcgggctggtgtggagatgctgttgggggaggtatgtcccccactcactctgctctggcactttgccgttgcccagtaaataacagatgcctttacatgtcacgattgtccttgctggtagtagtactattgatgaacccatagaagaccctgactttctcatgtaaaaacatcattttcagcagcagctggttactcatggttctgtacacacacacacacacacacacacacacacacacacagagcacggaggagaatgtaacagtagctgtccctgtgggatgaaagaactgctttataatttttcagttttccaaattgttttcattgagcataacttttacgattagagcaaaaaatgttcttcaatggttaaatgaaagagacgtggaattgagacctgtagggtgatatatgcccgtcttcggagtagagtgttgctctgagccagccccgtcctgttaggttttggagccctgttggtgctgaagcctgggcaccagccaatgtgaagctgtatgttccgcagctcctgcttcctgatcctctcctggcctctcgtggctgggggcgggggtgggggcagggcaggaaatgttggagttggagacctctggatgtttctgcttttctcgatgggtgaaactccagcctcacctcccaggcacattcttggggagaagcatcagagcccattttgttatttcaacaagtatttattgggcactttctgcttgtcaggtgcagggggagactaggatgagaggtaccaggcatgggtcccagccccttcccaagtccctggtgccagtctcctggtagaaaggccatgttctcttctccagagaatgaagagggagttactaagtgtaatttcttgctactccctacctttcttcatttagttacaggatcagatctttaaacattactgtggcagcccagcaagtgggttctgccgccaccacagaaataaagccatctggaaatgtctcctcaaaggcaggctgttggaagctgttccttgtgaggaattgcatgtccattgtgtgtcattacatgccaattatagaaagatttagactcagggaaagacagaaaggaaagagtaaaatcaccccaacaatgtgaaatcattttatacatttgctgtttacccaagcagcagttaggtgcacatgcaggcactcatttcttcacttattcgttccacctgcctgtcagggcacaccctctatgccagtcattgtcctgggccagggcctacagtcacaaacggaagaaataaaaacctctgccctcaaagatcagaccttccagagaaatgcagatggaaaaccagagagaggcccctgcacataagaagccccagcgagtgacccagagagaaacagcaggcgggaggtgggtggtgccctggctgggatggggtgctgttccccatgggcgaaggtgacacgtgagcagggaccccacaagggcgagggggcctccctggagcatctgaggggaccacacatgcagagtcttggaggtggggcacgttggagcatagtggaacagcaggtggtcactgtggctggaaagggggtgaggaagggctgataaagttaaggagatttgtgctccaccagaaagggcctgggagcgaatataaggatatgtcgttggctgtgtatgaaatgggaaccttagggtttcctgcagagaagcaacatggtttgatgcattttcaagcatcgggctgggtgaccactctgcatggggtgaggacagatgtgggcaaaccagtcctgggaaactggggccagggtcggtgccacctgctctggttggcgggtctggtctgcctctgaaccaatggccaacgccacggaaaaagtgaacattctggaggaaagcccggagaccagccccacagcccagccaggcatttgggaggaagtgcttttcctcctggcactctgctttcttggctctatggatgttcaagattgataattctgtaggacttcccaagagtagctgtgaaaatagggccagatgtttcagctcactgtttcagcctctgggaaaagtcagacagaacagaaccaggggctgaggggagcccggggttcatgttccctgcacagacctttcccacccaacacaccagggtgtgtgtttctgacttattctccccagcctggaaaatgcctcacttccaattctttgcattcttatgtgggtgttatggacaccgctcccccacagaaaaggggctgtctcttgttttctttaaaggtgtccatagtgatacctgtgatcttgacaagcagaaatgggctggagaaactttagaaaaaagaagcagtgatggcttggaactctgtgagtatgtgcacacgtgaaagtgtgagtgtggctctgtaagcatgtttgcatgtgagtgtgtgcatgtgtgaatggaaaacatttaagcgtgcatgtgtgtgtgcgtgtgtgtagcttttcggcaggcatgacatgtgcctggaaaggaggagtgttgaggaaggtgaaggcctaggatgtatgaatatgtggaggaagcactttggcgaacacagagatctgagtgtgtctgaccccaggacgtggagtagctgttgcttggagcaggtgtcttgaaggcgaagactaggatctgaacttaggaagatctctttcatctgtggagtgatggcccaggctaccatgtttggaatttcttctgtagctagtgggcaaagacagaaggtctctgagcaagaaggtgacctagtcggagcctgtgccaggctcatgggagcgtgcgcttgctgtggggagggcgtgtggatgacctccaccaggcaggaggcccttctggaattgaaggccagtgccatggaaatcagtcccaggattctgccagagaaatggagaggagggcgcggcggctaggaacattttgaggtagcgtgaaaggaagtggcactcttttggacgttgagggaacagcatgaagcctcagtggaccgagatgtgcagtgacaggtgtcaggaaatgccctgctcggcagcctgtggagaccgatggtgtgcactcgtgtggaggtgtggtgactgtctcttacacggggcgtttaaagtgaggttggaacagtgtcagcctggactggtcaacgtgggtcgggctccatcggttaggggtctcccagaggagagctgctggttgaaaccatgagactgctaagtggggaggggagacagggcccagaaactggggctgtggagagaatacctgtgtttggggctggaggaggggaggagcagttttaccaaacaggaggtgagcaggtttccagcaggaagcgcttgttgcatggcgcacaacaggtttcatgagctgggggtagatagccccatgtcagcggcagaggtgccaaggggtaccgggccctcacacatcctccaggggaattgagtgcgtcttgcttttctccacgtcccaggttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggtgagctgaagaggctgtgtgggatggctcgtgtacctaggcacctggaacacctgaactgtggtgtgtgtgttatttgtctctgtgtgtgagttttgttcgtgtcgtgcagaggtgagatgaaggtcaagtccatgaaggtcaagatgggaacctgcagcctcccgtggctgcgtggttgtggggagggggcagagccaggggtggatggacggtggagggcccttccaccggcctgttttgttccaagagaggagctttgctgagctgtggcacattttcagcttagagatgagctatacttttctggcagaggggttgactgcagggaaaaatacactgttcgcaccagaaaacaccaaaactgacactgtggctgttgggcagcttcgggttcctgctgttgtatcaggggcagagagagaggcagagcttggtgtctgcagatccgggcccttggggccaccagcccctaaggcttggcctgtagcatcttccatactcactgtgttgcccagacccaggcctgtggggccacctgcccatgaccgccacagatggcgccgcttctgagccacagccttgatcacctgtgggtgcggttctccttgttctgccacaaaggcaaaatgggacgctgtcacccctgagacaagggaagctggccaggtagattaggagacctcggaccctgtggggtggaaaaaatggcaaagttttacaggcaaagcagtgaccacagcactacccaggcctaggactggggtaggatcagggctgccgggtccatagccagtccccttcccaggactcggtgccacagtggggttctcattaactcagaattccccaaagtggagacattcagcggctctcctttttgctagatattcacatcttttactcactaccttttttttcatgttatttctaccagtttatttgctttttgtattttaaggaaatagaaataattgcagccaggcccggtggctcatgcctataatcccagcactttgggaggctgaggtgagtggatcacgaggtcaggagttcaagaccagcctggccaagatggtgaaactccacctctactaaaaactacaaaaattagctgggcgtggtggcaggcgcctgtaatcccagctactcgggaggctgagcaggagaattgcttgaacctgggtggcagatattgcagtgagccgagatcacgctactgcactccagcctgagtgacagagaccccatctcaatcaaataataataaataaaaataaaataattgctcatcagtgttttcccattgtgattcttctcagtccttggattatgaatcagattcacaggtcactgtgtattaggagatgttattcccattcaaaaacattgttttaaaaagaagaaaaaccctttcttcttaagactgtcttcctgtatttgatggactctgcagttgactcctaagttacttaacgctgaagttaggacataccctgttaggatctgacctgtgccttctaggggaaagtgattttttacttgtaatttattgtaagttatgactaaatgaacatgatgtcctattaaatttaatatgttccagtattcatttaaataatgcgcttaaattactggcatttggaagtgtgtgcgcactccgttaatccagtgtaatttttttatcatggttttgctgaattaggactgatgtgaactgtctgtgttttttatgtgcttaaatatcctcctttgttcttgtccaaactgacacagattactctcccagatgattctctcttttgccaaacttatttcaaaacatttcaaaagagctagatgtggagcccagcgccaggtggaccgcggctgtgttgcatgctaggtccctggtaaagaagttaaggatgttacccacacactgagcccctcgtctctttatttatgttttcctgtctcagcccattgctgactaaggggaaatgaaacataaacatgagaaaagatgcatgaccatcagagaccatggggccaggaggacttcacagggcagaggggttgccttcggcagactgtagagattgtgtagttctcatctactttgtgtttcacggccgcacggcgagtggatggcgtggcgttggcctgggctcgcctctgctgcccatccccagccgtgggacattccggaactgcgaggtctcttccctggaggaagctccttggattcaggtggaggctttagactctggtgagcctaaggaatgtgactattccagcccctgtgagtccctcccagcggtgggggacagaagagagcaggcacccagagcaggagccgcccggagcaggagggagtcctctgggaaaaggtgtggacgcttctggtggccctagtgtgctgtcctcagccacagaccagatgctgccagggtcctcccgaccaagtttcactcccaggggacatcttagagctagaagttcaacctgaatgtcattgaacttagaagaaaaagggacaatttgtctttgaaagactaaatgctagtttacataaaattgtgtttattctacggtaagaccaatggccagtgaggacacagccctgtgtgcatcctgttcagtaagcaacaaaatctgtcttgatcctagggttcagttggtggtcactgatttgagttttgtagaaaagggcagtgagaattatagaatatatatatgttaaaaatcgagtagagctttgaatagcagttgaaacaggcatcatctgctgcgtagtcgagttctaagatgagattagctgattcgtagtagaagttgtgacatgttgcttataagcctatatttctaaggaattggaagaagtcgatgaaaatgtttgttcttgaacacataaacctaagttttttgccctatctttgcttagcagatattttctttatggcaaatatattttcaatatatagtagaatcaaatgttattctttaaaaatgtatatacttttaaaaatacacatgaacaataaactatatacatttagctatatatagtttattgttcatatgtttattttaaaaagattggaagggtatacattatgatgttacgtgtggttatccctgaatagttggaaaaggtgtggcttaaattttcttccttatcttttcttggcttttctaaatttgttataataaatgcgtttgtgtgtgtgtgtgtctcacatatataatagaaagtagggaaaatcctttaaagcattgtggagagatgcagcaaagaagtaaatattttctttgttaagtaaaattctaaataatgtaaaatagtgatagaaagaaagaactgtttttatatttgctgtattttttaccacgtgcagctttgttaggtagatttcagttttctctttattttttaggttgtatggctcgacactcaacatcgacctgtttccggcgctcgtggtggaggacctggtgcctggcagccggctgggccccaccctgatgtgtcttctcagcacacagttcaagcgcctgcgagatggggacaggtgagcacgtgcaccagaaaggggagcacgctcctaagccaccttcttagggactccagaggagaagagctgtcctggttgagactgagggaggcacgaggccctagtgtcttctgtgtgtccccggttgagaatgaggaaggcactgaggccctggtatcttctgtgcaccgccttgggcttacatgtccttgcagcctcaaaactcaaccacaccaggttcaatgatgcttttcccaccccttcatttataggaatatttctgttcctgtaaacctgttggacagtccatacagctaaaccactgtgggactttagaggagtttgggcttcgggcaagatctttgttttatctctagtctactgttattactttactttaatgtagtggaaaggcagaccctacctattacaaactatttcagcagacctgaaataactgccatgccagttttgttttgtttttttaaagttgcccatcgtctttgttgctagtcagaagagctaacactgtcgttctttttttttttttttttttttttttttgagacagagtcttgctctgtcacccaggctggagtgcagtggcgcgatctcgactcactgcaagctctgcctcccgggttcaccccattctcctgcctcatcctcccgagtagctgggactacaggtgcccaccaccacacccggctaattttttgtagttttagtagagatggggtttcactgtgttagccaggatggtctcgatctcctgacctcgtgatccgcccacctcggcctcccaaagtgctgggattacaggcgtgagccactgcacctggccaacactgtcatttttacaccagattgtctgcctttggttttgttatggggtaggggatgtgagcagtgtgtgagtccatttttaagtgacacctaatcaaacctagtggtttctgtattgctgtgaactaagcaggggagattttaactcagctcctagtgacctgtgagtctcctgcccttctctgatcctgctttcattttgggggatccaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaaggtgcgtgccaggggcaccatgtctgttcctttttcatccctggttttggtgactgcttggcgggtgcttaatgacctgcagatgtcatcctaatcttgaaaactgaaaacaaaatattcagctttagatttaaatcgtgctgtatccatgctgagatggactgcggagccaaaaatatgaacaaagttggtgattctgaggaattggcagtgctgtgggagaacattcagaataactaaaacactaagagaaacagaaacccaggcttcagcaagatgtgcccctaatttttccttaaagcctaatgtatgtctagcttccagtacttgtgtagccagataaaagacgaaaatcaaaatatggaagaagcatatcaaatatatcaggttttcttaaaagttaatctgaatgttgtaaatatctgtaacataagtgactgaagatagatgttatcaaatatctcgtgaggagccctgcaggtaggaggtggtctcatgattggcgcggggggccctgtagctgagggacgccctgatatcaatcccacagccccggcactcgtgccctggagtgccagctccgtcttccctgcagaggcgtcagtggcctgctgtgtgaggcgatggttctcctggctgagttcctgcttcgcattcctaactcccagtcttggttaacctccatttccattactaatttgaacataattttggctttattcaaactatgatcagatccccataaaataccaaactggggatgtttagaacccaagttgtggagcactcactcttgtggtgagagaagcagggcccaccacaatggggggatctggggacctgcggtgagcgtgaccgggaggtggggccagatcccggcctcacccggcaatctgtggagcttgtggtgtctgtggacacttggtagtttaagaagagacacacaaagtacagacactgtccacatattctccaccacctcatttttcctgaagtaatagttctggccaagagcttatttaatttagtaagcgttgaaatctgcactgataatagagctgtgttttagcagcttcttctaagagagtgcgtgcctctgtgtctgtgtgcgactgtggggtgtgtgtgtggagtgtgtgtacctgtggggtgtgtggggggtgtgtgtgatctaatcctgcatctgcctcctcatctgcaccccccaccacccacacacacatgcatggaagtatatatgataggagaattcacataaaaaataaaattatgcttgctaggtacccaattttccaaattatttacatgcttgttattacatctgttggaaacttatatctgttttttgttttattgttttgttttgtttttgtttttgttttatatcctcactggtttatccaattcaaaatgcttttctacaagcatggtagaaaatttgttctgtttgtagaaaattgttctcttgaaaatgattaggaaaagccaatgatacaaaaacccattttctgataactttaccaggcccctgttagctgcttattaagaagtacagccaggctttctgttcttttgctaagaaaatccaaagtcctttgaaagacttcatctttaaagccagtctttgttccccgcatgttacaagcccctcctcctctcagggcactgtgggagaggcttagctgctgaagcaattgctgacattgtttcttccggacacttttccctcttaaaataccaggcatggccttaagctgacacagcttagagaatacttgataagctttacctgtttttattttaccccaaaagccatatctaaatacagcagaaaaatacgaaaacagaactcagatttgacagaaccaaatgtcaattgctatttacttttcaattaaactttttaaaaagacacattgggggctgggcggtggcacatgcctgtaatctcagcactttgggaggccgaggcaggtggatcacctgaggttaggagttcgagactagcctggccaacgtggtgaaacccgtctctacaaaaatacaaaaattagccgggcgtggtggcgggcacctgtaatcccagctacatgggaggctgaggcaggagaattgcttgaacccaagaggcagaggttgcagtgagctgagatcgtgccattgtaccccagcctgggcaacaagagtgaaactgtctcaaaaaaataaaaaaataaaaagacacatttaaagcgaacgtccttgagctacaacttttcatcatttgcttcgttgatgcctacaacaagtgctgtgtggggtctgcactaggtctgggaagccagcctgctcctggcttggccagcctgggcagcacagagcaggtgcaggccaggccgctgagcaggtgtggcccagccgtgccctggggtgtgaggaagagacggccatcctggagggacggaggtcccatcaaagagttctggggttggggctggtgtgcgctttggcagggaccccacagtgcctgggaccgtgtcctggccctgctgcttccctgtcgccctgtaattctaccagggacccaccccagacctgcacagccctgggtggaccccacctgccagtgaggctcattcttgaccccaggtgttgctgggaggggctgcggtagtctgggaggcagctgctgttttatgatgtatttgtgtgcccaggagttttaagaaactctgctcttctctgctcctgagacgatttgtgggtggaagaagcgaggggtccagccagctgggtttactcagaagctgtatagttaactgcggaaataaacacattcagtgggactgtttgtgggctccgctgtgggggcagagggagctttaggtctctgtcttgaagatactctttccagccagtcagacaaatgctagaccagaaggagccggccgcccttcaagggagacaggaaagctagcatggggtctgaggtgtatgctgcacgtgcctcttctcttctcatagaatttctactccagtggcttcctgagacattagcattttgcaaaggtccatatttgcccttcactttcgtgctctgccacagctttcttgggtggggatgatgtacaagacagactgaacaccccattacttcgttagatagtgtgtccacagggcccaggtgggacacggcactgagggcccctcactcacccggggaccaggagggacacggcactgagggcccctcactcacccggggaccaggagggacacggcactgagggcccctcactcacccggggaccaggagggacacggcactgagggcccctcactcacccggggaccaggagggacacggcactgagggcccctcactcacccggggctcaggtgaggcatagcactgagggcttctcagtccaccacaggttgagaaggaagccactcctaggcagggaggtgtttgggctacattcaggagaagcagggtcaggccgcctcttgtctgacactggggctggcagtgtgacgtagggagtgtagcataattttaaggcactccagagtgcagattgtcatctggccatcggggagggacccccagaaacagcagactctgatctccgaggcagagtgcctgagcctccatctgtgggtggagggaactccgcgagggtgtggttagatggcgtggtgagcctcctcagtgtgcccagctgtcctcagggcggccagcaccaggaggtcatgagggctggggcacaggtggagagaggcttggcccctcagaccaggagagggtaagagccgcagaccagctgccaggttgcctcactgaaatgtgccacagtttgttccacgggcagccagtgaagacttcatagttggcaggatgtgcttaatttccccgaggtcagagccttcagagctgacattctgctttgtgcttccattttagactgtaggaccagggggcagttcaatgccttttcctatcatttccgaggcagacggtctcttgagttcagctaccaggaggacaagccgaccaagaaaacaagaccacggaaaatacccaggtatggtggtctctgaggtcaaatgatgtgcagaggggccctcgcaccgcgggcgtcgggcagtaggaccggcatcctgctgtgggcctgtggcgaggatggttcctggcagggacgtcccagggcactgggggccaggccgcagcctgcgtcctgctgtgctgcccactcagagcatcaggggcggtgcacacccaggaaaccttgaaatgagacccagctcagagcatcaggggcggtgcacacccaggaaaccttgaaatgagacccggcgtgacctgccaaggttatatttccctcctcctcctttcccctcaccacagtgttgggagacagggggaacatctcagcaacagcacctcagccttcagcacacgctcagatgcatctgggacaaatgacttcagagagtttgttctggaaatgcagaagaccatcacagacctcagaacacaggtgaggtgcctggcggcctgtgtccccccactccaagattccacagcagcacagccctgcccgaaccttctgggtatagcattttattcccaggcaactgttcaactgcccacacaggacccagaccctggagccttgggggtgtcatttctgcacgctgggtcaggccgggccatgtgccactggtgtccctgggtttcccagcagatgggggtcaccaggcaggggcaatctgtgtcacggccgtgtgactgccagccaggtgaccttgctggagggaacacaggattaggatgctgtaggagagttcagacatgaagtcctgttcttaagcctcttattcaggaataactctgaatcatctctcccagggcgtggtaaggaggcacttccaggtcagccctccacaactgatccagcctctccgggtgtgaggaaagtcctggtgtctgtggtacgaccacagggattttcagacggggctcttctctggcgctctgtggaaatgagttctgtcctctccttcctatcccaggaacttacttctgctttcttcagtgcctgtggtgggggttatctctgggattttacgtaagggggtggagattgagacctatggctaaatagaaggaagtgcgctcactccgctggtgtggatgggattcccaaggtgcgcaggtcctggctgtctgcagcacatttaatctgtaagcacagctcctttcctactcacaggactcttagcccttaggtttgggagaaacttccatcatctcctagtgtagccccaaggtaacccccagccacagggagaggtaccctgactactcctgtgcctgccccctcatcccgtgcagctgcaggtcctcctgcctctgcagccttgagaccaggtgcaagtccccaggcagctgtcagagtggacgacatgtggcaggtcctcctgcctccgcaacctagagaccaggtgcaagtccccaggcagctgtcagagtggacagcatgccgcaggtcttcctccctccgcagcctagagaccaggtgtacatcccccaggcagctgtcagagtggacagcgtgtggcaggtcctcctccctccacagcctagagaccaggtgtacatcccccaggcagctgtcagagtggacagcgtgtggcaggtcctcctgcctccacaacctagagaccaggtgcaagtccccaggcagctgtcagagtggacagcgtgcggcaggtcttcctccttctgcagcctagagactaggtgtacatcgcctggcagctgtcagagtggacagcgtgcagcaggtcttcctccctccgcagcctagagaccaggtgcacatcccccagcagctgtcagagtggacagcgtgtggcaggtcttcctccttctgcagcctagagactaggtgtacatcgcctggcagctgtcagagtggacagcgtgtggcaggtcttcctccctccgcagcctagagaccaggtgcacatcccccggcagctgcccaagtggacagcatgcagtgttcactcagctccacctggcactaggagagaagcagagacaaacccaggctgacccttggggtccgtgctggggcctgggtgccctaggggggtccactggggaggggggtctgtgaaccccaaggtcattcagggcaggccttgtgcacaggtgaccctggacagcatagcagaggcagagggggaccagccaccccacctgtgtcggcaaataccaacgccctatgccctcccatgttgctgattctgtccacaatgctggacttccttccaccctcaggatgaacgggcagctccctgggtggcagcgctgggtctgagaaatgtggatgttccttgtgattttgcagctgctgacagcacagggtgtgtgccgtctgtggtcatttccctgcaccccatgtgtgcagaggtgttcgtgtatcttggtgactgcagaggcacacacaggccggcgtggtcactgcttctctctggctgtgaattaaagcaggtcagccgcagacacagaggtgacatgcaggtcacctggaacctctgcagaccgtcctggctgccacccctaagtgctctctggcccctgtgccactgttcctgaggcttcctttttttttttttttcccccatggtttcagctagaaagttctaagctttgataacttaagtgccagttgctaatgaatgaggcatgcaggaaagatggctttcatttagaagccgtatctgaggcatttcccaaagtgagtaactgtttggctagttaggtcctagatgtccagctgtcattatgaaatgcagatggtacggtgaggggacgtccacctttttcagcatgatgtgtgcataggtgagacactgctgctgcacaggttggggaccacacacttatggctgacaggagatcaaagaagatgttttaattgacatgagtaagtgggtggcttgctgaagttattcacagccatcatcagacagccttacctgtggctgagcatgctttatgaaggcttattagaagaattgggatatttatgataaataatttgtgttcatttcagacatcacagacagtttaggttcaaatgcaagggacggaaaactccaaatccaggatggttttaatgaggtgcgagtttacttttccctcagtcgtggagattgctggaccctccgcagtgcagggtccctgctgcagcttggtgctgtactgtgggtggcctcttcccaaggtcacctcatggcccaggcatttccggccactgtcaccctgtctgccccccggccctgcaagatgcaagagagggtttgaggaaggagacccttccaggaggcttctgctacccctgtgcatggcacagcggttggaaaggtcaccttgttatggggccccgtgcttccagagaaaagccagtggtgttgttactcggaaaataaggcagacttgactctggggattctgagtgatcatcgttcgttctggtggaagtgtaggtgcaggacgttctcgtcatctggttgaatcttgctcccacagtcctctgagaacgtcgcctttgtgactacggtttttatttgacagcacggtggtgggaatgtcttccattggggcgtgtggtcagctgccgccagtctaataaggacattggagattctgtaaaagttcttcagaaatattcccctcaaatgttgtttattttaaggcattattttcagtgaaataacatcttttaatacaagagccaagctgttactctgaagtgcccaatgaatgaatgttctttgcattgctgcagataaagaaacttgaatcacggctcagtaccacagagtgcgtggatgccgggggcgaatctcacgccaacaacaccaagtggaaaaaagatgcatgcaccatttgtgaatgcaaagtgagtatggggggctctatcttcatgtcctaaggtatacgcaagtccgagagtcccatgtgaccactcaggtgggtggcccagatgtcagggccaggcccctccccgcctacctgtgctggcctccatccctccttcactcctatggaagcaccaggcaagcccagctctctgtgcacagaggacgtgctaggaggcccagaacctcagcatggtccaaccccacagagggcgggcagcccctactctgtgcagggccacctggggctgcttgtgtgcactggcttcacctcccaccagctgtggcaggaatactcatgccatggaaacccatgaatggggtagatcagctcctccctgcagagctggtgggtaaacactgacctgcccaccactggccctgtcccatctccagtcagagctgggggtgttacagaggtcactggagtccctgcaaagggagactggtggcaggtggagggtgccctggtgccggcaatggacagacgtctggctggaaccaggctccgtggaaagcttggggcatagtgtgaggaggcaggatggggaggacagcgcgccagcccgggcacttctcttgccatggccattgggagaggacgcgcatcagtgtccctgagctggtcaggtttgggaagggcagaccggggaagagcaaagccctgtcccttcccccctctctctagtcccatcctgcttcctgacaacgcccacccccagacacagtccgaggggatccaggtgtgaggtgggaggatgtgtccagctggtggtcttggcccctcagggtgagaggaccgtgggcatggacggaagggtgggacgggagcctcagggagacttgttatgggggctcccattaactcatacctgtctgcaactatgaaatcctaagagaaccacaaaatccatgcccacagggcaagtacagcgggcaaggcaggggcctcagggcaaggcctgactcatggccgtggctgacacctgtcccggagctgacaggctttgctcacctgaaggccatcccagagctgacaggctgtgctccgtctctcttctccaggacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggagaatggctttat

SEQ ID NO: 14076 - DNA, 3975 bp, Homo sapiens
gatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagttt

SEQ ID NO: 14077 - DNA, 304 bp, Homo sapiens
gcacccatggattcaaccaactgtggataggaaatattcaagaagaaaaaagcatctgtattgaacatacagagattttttttcttgtcattattctccaaacaatacagtataccaatgatttgcataacatttacgttgtattaggtattataaagtaatcaagagatgatttaaagtacatgggaggatgtgtgtcagttatatgcaaatactgtgtcattttacataagggacttgagcatccaaaatccttatctctctttcataacgtgtcacagttgagttttctatttattttccg

SEQ ID NO: 14078 - DNA, 2217 bp, Homo sapiens
gcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggtgtgcggccggggggaggtggccgcccgcgcgcgctggtgacggtgggagtgggcggagagggtgctgattcctggcgcgtctgcacccaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggtgcgtggggcgggaggcggggcggggcggcgcggcctggccggcctgggagaagcccgggccccgctcagcctcggccctttgaccctcacaggatagcgaggctgcggcaggaggagcgggagcaggagcagcggcaggcgttggagcaggcccgcaaggccgaagaggtgcaggcctgggcgcagcgcaaggagcgggaagtgctgcagctgcaggtgggcaacgtctccggagggtgggactccagccggggacgcggcttgcggggcactgggaattctgggcaccgcgacgcgggcgctggctatgtgcagagacttacagttggcaggtccggatttggagaggagagtgccagtcaggcgcaaagacccggaggtgagcggagtaattggacagtgttcaggtacctagcaggtctgtgggagggaccctgcgttccacaaagaggttgtattttgcataacaggtgatgaagccatgaagggttaagtatttcaggctaggattagcaggtgtgcgacttaaaagcagggagaccacttaggagtaatgcagtgagaatggatgaggcttgatttaaagtatagaagggtggctgggagcggtggttcacgcctgtaatcccagtactatgggaggccgaagcgggcgtatcacttgaggtcgggagttcgagtccagcctggccaagccccgtctctcctaaaaatacaaaaattagccgggcgtggtgtgcgccagtaatcgcagctactcgggaggctgaggcatgagaatcgcttgaacccaggaggcagaggttgcagtgagccgagatggcgccactgcactccatcctgggcgacagtgagactccgtctcaaaataaataaataaataaataaataaagtaatggggggaaggatgagttagagtgattcagaggggaccactgagggacggatttcacctaccaggacgtgagattttcatagctggcactcggggctatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagccacaccca

SEQ ID NO: 14079 - DNA, 2216 bp, Homo sapiens
gcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggtgtgcggccggggggaggtggccgcccgcgcgcgctggtgacggtgggagtgggcggagagggtgctgattcctggcgcgtctgcacccaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggtgcgtggggcgggaggcggggcggggcggcgcggcctggccggcctgggagaagcccgggccccgctcagcctcggccctttgaccctcacaggatagcgaggctgcggcaggaggagcgggagcaggagcagcggcaggcgttggagcaggcccgcaaggccgaagaggtgcaggcctgggcgcagcgcaaggagcgggaagtgctgcagctgcaggtgggcaacgtctccggagggtgggactccagcggggacgcggcttgcggggcactgggaattctgggcaccgcgacgcgggcgctggctatgtgcagagacttacagttggcaggtccggatttggagaggagagtgccagtcaggcgcaaagacccggaggtgagcggagtaattggacagtgttcaggtacctagcaggtctgtgggagggaccctgcgttccacaaagaggttgtattttgcataacaggtgatgaagccatgaagggttaagtatttcaggctaggattagcaggtgtgcgacttaaaagcagggagaccacttaggagtaatgcagtgagaatggatgaggcttgatttaaagtatagaagggtggctgggagcggtggttcacgcctgtaatcccagtactatgggaggccgaagcgggcgtatcacttgaggtcgggagttcgagtccagcctggccaagccccgtctctcctaaaaatacaaaaattagccgggcgtggtgtgcgccagtaatcgcagctactcgggaggctgaggcatgagaatcgcttgaacccaggaggcagaggttgcagtgagccgagatggcgccactgcactccatcctgggcgacagtgagactccgtctcaaaataaataaataaataaataaataaagtaatggggggaaggatgagttagagtgattcagaggggaccactgagggacggatttcacctaccaggacgtgagattttcatagctggcactcggggctatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagccacaccca

SEQ ID NO: 14080 - DNA, 1334 bp, Homo sapiens
gccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggtgggtgtctcccagcctcatggggaggaagaaagtgatggccgggggctcccccaccctcctggagcctgaggtcggggtagggaggacagcatcagttcccttctaaggaagggccctggacactgcagcaggcagcccagtccagactgcccatggcctcccaagtgatgccctggctcccctggacgacagcatgccctgggagggcaggaccacggcccagtggtcccttcacaggaagcgacacctggcacggacactgctggtgagtagggtgagaggtccccagcatcaagaccagccactggtcatcagaggccattgtggcttagggttgggtgctgggagggtggggagaatgaaacaccactgagatgccccctgccacagcacccccagccatttctcagtgcccctactgcacacagcagggtgctgtctgctatccttcctatttcccaggaggattctagacaatttacaaagcacttgggttaaagaccaaagtcactagtagactagaaggagataattgttctataagacagtggtggccatgggatcccacaggcatcctgacaagccaatgactgtcttgaggtggacagaccccaggccagtggaaagaggtgagggatgcaacctcactcaaacagacaacagggccaagaggaccaggtggtgactgacatgtgcactaggaacatctcagggactgcagagctccccaagaccatagcagaagacaggcgtggggaaatggtttgctactgttttgcaaatcaaacatttacagtgcatcaggagagcccggtaactaaagaagaaagtggttagttcctatgaggcaatgtcttaccgcctgatttgtgtgtatgtgctgaggtttctatgcgtcaggcttgtttagggtggacaagagggcatgcccaagggagctggagatccccacactagctggatcctcaggcttctacgggaggcggggggcgtcctgctgtgggaggccacatggggactgggggggacgagaggggagagaaccaggaagatggcagctcggcggttacgagaccagtgtcctgagacatgaccgccacctctccctccgcagaccgcagcccgagagccccgccccgccccgccatcctccaataaagtgtgaggttctccg

SEQ ID NO: 14081 - DNA, 225 bp, Homo sapiens
tttttttttctttcttttttttttgagacagagtctcactatgttgcccaggctggagtgcagtggcacgatcttgctcactgcaagctctgcctcccgggttcacgccattctcctgcctcagcctcccaagtagctgggactacaggcgtctgccaacacgcctggctaattttttatatttttagtagagacgtagtttcactgtgttagtcaggatggtct

SEQ ID NO: 14082 - DNA, 1333 bp, Homo sapiens
gccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggtgggtgtctcccagcctcatggggaggaagaaagtgatggccgggggctcccccaccctcctggagcctgaggtcggggtagggaggacagcatcagttcccttctaaggaagggccctggacactgcagcaggcagcccagtccagactgcccatggcctcccaagtgatgccctggctcccctggacgacagcatgccctgggagggcaggaccacggcccagtggtcccttcacaggaagcgacacctggcacggacactgctggtgagtagggtgagaggtccccagcatcaagaccagccactggtcatcagaggccattgtggcttagggttgggtgctgggagggtggggagaatgaaacaccactgagatgccccctgccacagcacccccagccatttctcagtgcccctactgcacacagcagggtgctgtctgctatccttcctatttcccaggaggattctagacaatttacaaagcacttgggttaaagaccaaagtcactagtagactagaaggagataattgttctataagacagtggtggccatgggatcccacaggcatcctgacaagccaatgactgtcttgaggtggacagaccccaggccagtggaaagaggtgagggatgcaacctcactcaacagacaacagggccaagaggaccaggtggtgactgacatgtgcactaggaacatctcagggactgcagagctccccaagaccatagcagaagacaggcgtggggaaatggtttgctactgttttgcaaatcaaacatttacagtgcatcaggagagcccggtaactaaagaagaaagtggttagttcctatgaggcaatgtcttaccgcctgatttgtgtgtatgtgctgaggtttctatgcgtcaggcttgtttagggtggacaagagggcatgcccaagggagctggagatccccacactagctggatcctcaggcttctacgggaggcggggggcgtcctgctgtgggaggccacatggggactgggggggacgagaggggagagaaccaggaagatggcagctcggcggttacgagaccagtgtcctgagacatgaccgccacctctccctccgcagaccgcagcccgagagccccgccccgccccgccatcctccaataaagtgtgaggttctccg

SEQ ID NO: 14083 - DNA, 291 bp, Homo sapiens
ttttttttttgagacagagtctcactatgttgcccaggctggagtgcagtggcacgatcttgctcactgcaagctctgcctcccgggttcacgccattctcctgcctcagcctcccaagtagctgggactacaggcgtctgccaacacgcctggctaattttttatatttttagtagagacgtagtttcactgtgttagtcaggatggtctcgatctcctgacctcgtgatccgcccgcctcggcctcccaaagtgctaggattacaggcgtgagccaccgcgcccggccg

SEQ ID NO: 14084 - DNA, 4822 bp, Homo sapiens
aggaccgagaggagcggaagctgctgctggaccctagcagcccccctaccaaagctctcaatggagccgagcccaactaccacagcctgccttccgctcgcactgatgagcaggccctgctctcttccatccttgccaagacagccaggtaagtgtcagaggaccaggcctgggtcagagctcctctatccatattaaaggctaggatagaaggagccaggctcaggacatgggggatgggacaaggtcactggggagaggtgcctccatgtccagccctgctccagtaggcaggagggaaactggtgtcagatagccctggagttggtacctggcactgagtcctgtttgtccttctcggaagcacctgtcatgtcatctctgtctcctctccccatagcaacatcattgatgtgtctgctgcagactcacagggcatggagcagcatgagtacatggaccgtgccaggcagtacaggtgagcacctggccagcgtgggtccctcaggctacttgggctcccaccctccatcactgttccagctttggagcctggcccctagtccaagcttctcatttggtgcagccctggagactgaccacagatcacttgggtgcttcagtagttattcatgtcagccctgtttaccctgtgacactcttgagggcactgaggccaagggagatgggcctagattgagtctgtgatgagctgagaccttccctcccagatacccctcctcgacaccctgcttctctggcctgaggggatgaggcttacctgggctgggcagggcagactgtagcttaactgcctacccccaccccctctctcttggtcagcacccgcttggctgtgctgagcagcagcctgacccattggaagaagctgccaccgctgccgtctcttaccagccagccccaccaagtgctggccagtgagcccatcccgttctctgatttgcagcaggtgagacacccctcacctgcccctgcccacccttctcacactgcccagggtatggcagagggttcacccactctgcctcagaggaggtagggaaggtggagttagggagcctggtagccttgtaggccccagctccctcccacctcgttctcttaactttttatgtctttcctatctccttcctgcaacctttattgtttcactcccctttgttcttttccttctgtctctcccatccctgtctttctctttgccttcctgttccccttcattccctccttctccatcaccatctaatctcccctccccatttttcctgattgccctcctcacctgtctctgttcctctcctccccggcccctctctgtctcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatccatgtgctggttctggcccctctgttctacccattctacttttgattacttaggtctatgagagtaagatggggggaaggggacatcttccagggatattgaagatgaacccaagagacaagggtttagggtgtcagctcttagctgagacctggcttgggctaacctcagactggatgagactgttcttgtcccttgtccagtgatgatgggaacactgtcaaagctgaacagacctgaatctgaggcagctttgattcttgggggccctgcctcagactcaatggaattaccaacagcccctgggggtgaagggagacatggcgggttggggggtggagagagaaagcagaccaggctcttctgggaatacctaatatggagtcagcaagcaaatgtttttaagcagaagattctttttatcaaatgaaatcttaagcagaatcccagcatataaaacagaatggaattactttgatctgattgaagtgggggctggtttcagagatcataggccatcttcttggcctgtcatggaggcctgtgaggcatctctacagaccctggtactctgtgaagagtttggaaattactgatctactttaacccccaaatctctaagctgaaaagtacaaaggggcccagagagttagataaatttcccaaggctgtgtggtaaacccacgtctccagtgtcccaggccagcaggcctttccctcaattgcctccctttttcagcaaaataagactagagctggccaggtgcagtggcttatcctgtaatcctagcactttgggaggctgaggtgggcagatcacctgaggtcaggagtttgagaccagcctggccaacatggcgaaaccccatctctactaaaaatacaaaaaaaggctgggcgtggtggctcacgcttctaatcccagcactttgggaggccaaagcagacggatcacctgaggtcaggagttcaagaccagcctggccaacatggcgaaaccttgtctctactaaaatataaaaaattagctgggggaagccgaggtgggtggatcacaaggtcaggagatggagaccatcctggctaacatggtgaaaccccgtctctactaaaaatacaaaaaattagccaggcgtggtagtaggtgcctatagtcccagctacttgggaggctgaggcaggagaatggcgtgaacctggaaggcggagtttgcagtgagccgagatcgtgccactgcactccagcctgggcgacagagcgagactccgtctcaaaaaaaaaattagctggatgtggtagcaggcgcctgtaatcccagctactcaggaggctgaggcaggagaatcgcttgaacccagcaggcggaggttgcagtgagctgagatcgcaccactgcactccagctggggtgacgagtgaaaccgtctcaaaacaacaacaacaacaacaaaattagccagtcatggtggcaggcgcctttaatcacagctactggggaggctgaggcaggagaatctcttgaacctgggaggctgaggttgcagtgagccaagatcgtgccactgcactccagcctgtgtgacagagtgagactccgtctcaaaaaaaaaaaaagaaaagaaaaggctagagctacttgcagttgcctgagttagagaacatctctacaaggtgtaagtgacttctcatctgctcaacagctcaaattatttattgtcaaaccatgctgtctatgcttaggcctttaggactactagggtcgtgggagcctcaaagtgtattctgcttggtccaggccttcttgggcttgatgttcatgcgtttccagacttcagctgtggtgcggtctgctttggtgaccccactgaagtcgaacgtggtgatacgggacagggtgcacagcacatattgcctgtggggaagacttaggctgggggccagcacccccaccagaatccccttccccctccactagttgctgttgtcttccctgactgcaaggaatggagggacttgagcatagtttgggaaagattaggtttatcctgactgagagcaaggaatgcttagaggtctgttactcccttcccaggtccaagcatggcagaagaatggtcgtagatttcttgtttctcctcctcctttcctttaggggagcccagctagacgctacctccaggggcagggcacttacctataccctttctcttcctccatggggttcccatggagtgtcaggctacggagccgaggaaggacagccagcttattcacctcccccaggcgctggatgctgttgccgtgaagatagaggacactcaggttgaagaaagttgttaggacctgttggggagggaaaccaaaagccaggctagacaggacaggaccctgaatctctgctcagggctgactcgtgggcagagaaggaagaatgtggggaacaacctgccctccactccaaccctccacagccatactgtatgactgtaacctacttttatttatgttttaagacatacagggcatcacactgaaaaggagctgtgatctgagggtcaggagtgtgggcctgggtaccagcactgccactgacttgcctctctctcagccttagttgccccttcactgaagacctttccagctttggtgatctacgattctatcacagcaagcaacaggaagacagagcatcatgctaggcacataagaagcttttaaaatactggttaaattgagatcaccacaccaggggaatagtgtccaagtcatgctccagctcctttcccctcttagggatcttggactagaaaaggcaactttgtttatttcttaaaacttgaatctgagtcacagaaa

SEQ ID NO: 14085 - DNA, 1967 bp, Homo sapiens
aggaccgagaggagcggaagctgctgctggaccctagcagcccccctaccaaagctctcaatggagccgagcccaactaccacagcctgccttccgctcgcactgatgagcaggccctgctctcttccatccttgccaagacagccaggtaagtgtcagaggaccaggcctgggtcagagctcctctatccatattaaaggctaggatagaaggagccaggctcaggacatgggggatgggacaaggtcactggggagaggtgcctccatgtccagccctgctccagtaggcaggagggaaactggtgtcagatagccctggagttggtacctggcactgagtcctgtttgtccttctcggaagcacctgtcatgtcatctctgtctcctctccccatagcaacatcattgatgtgtctgctgcagactcacagggcatggagcagcatgagtacatggaccgtgccaggcagtacaggtgagcacctggccagcgtgggtccctcaggctacttgggctcccaccctccatcactgttccagctttggagcctggcccctagtccaagcttctcatttggtgcagccctggagactgaccacagatcacttgggtgcttcagtagttattcatgtcagccctgtttaccctgtgacactcttgagggcgctgaggccaagggagatgggcctagattgagtctgtgatgagctgagaccttccctcccagatacccctcctcgacaccctgcttctctggcctgaggggatgaggcttacctgggctgggcagggcagactgtggcttaactgcctacccccaccccctctctcttggtcagcacccgcttggctgtgctgagcagcagcctgacccattggaagaagctgccaccgctgccgtctcttaccagccagccccaccaagtgctggccagtgagcccatcccgttctctgatttgcagcaggtgagacacccctcacctgcccctgcccacccttctcacactgcccagggtatggcagagggttcacccactctgcctcagaggaggtagggaaggtggagttagggagcctggtagccttgtaggccccagctccctcccacctcgttctcttaactttttatgtctttcctatctccttcctgcaacctttattgtttcactcccctttgttcttttccttctgtctctcccatccctgtctttctctttgccttcctgttccccttcattccctccttctccatcaccatctaatctcccctccccatttttcctgattgccctcctcacctgtctctgttcctctcctccccggcccctctctgtctcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 14086 - DNA, 1967 bp, Homo sapiens; identical to SEQ ID NO: 14085

SEQ ID NO: 14087 - DNA, 509 bp, Homo sapiens
tgatactcttcctaatatccacagggagagaggatgatatgactcccaatatcgcaggtggggtacaaaaccctgtgatattgttcctaatatccagagcgaaagaggatgatatgactctcaatatcgcagagggtgtacacccctcctataatattgttctgaataccctgggagagagaggataaggttacgttgaatatcgcagggaatgtacaccaacccctctgatacccttcctaatgtgcaggggaagagaggaaaatttcactcccaatatcacagaggcagtacaccccacttgtgatgttgttcccaatatgcaagggggagtacaccccacttgtgatgttgttcccaatatgcaagggggagaggatgatactactctcaatatcgcagggctgttcacatccccagtgacattttttcctaatatctaggggagagacaattatatgacagcaaaggtcgcagggtctgtacatcccttcctgatattgttccta

SEQ ID NO: 14088 - DNA, 1142 bp, Homo sapiens
tgtttttaagcagaagattctttttatcaaatgaaatcttaagcagaatcccagcatataaaacagaatggaattactttgatctgattgaagtgggggctggtttcagagatcataggccatcttcttggcctgtcatggaggcctgtgaggcatctctacagaccctggtactctgtgaagagtttggaaattactgatctactttaacccccaaatctctaagctgaaaagtacaaaggggcccagagagttagataaatttcccaaggctgtgtggtaaacccacgtctccagtgtcccaggccagcaggcctttccctcaattgcctccctttttcagcaaaataagactagagctggccaggtgcagtggcttatcctgtaatcctagcactttgggaggctgaggtgggcagatcacctgaggtcaggagtttgagaccagcctggccaacatggcgaaaccccatctctactaaaaatacaaaaaaaggctgggcgtggtggctcacgcttctaatcccagcactttgggaggccaaagcagacggatcacctgaggtcaggagttcaagaccagcctggccaacatggcgaaaccttgtctctactaaaatataaaaaattagctgggggaagccgaggtgggtggatcacaaggtcaggagatggagaccatcctggctaacatggtgaaaccccgtctctactaaaaatacaaaaaattagccaggcgtggtagtaggtgcctatagtcccagctacttgggaggctgaggcaggagaatggcgtgaacctggaaggcggagtttgcagtgagccgagatcgtgccactgcactccagcctgggtgacagagcgagactccgtctcaaaaaaaaaaattagctggatgtggtagcaggcgcctgtaatcccagctactcaggaggctgaggcaggagaatcgcttgaacccagcaggcggaggttgcagtgagctgagatcgcaccactgcactccagctggggtgacgagtgaaaccgtctcaaaacaacaacaacaacaacaaattagccagtcatggtggcaggcgcctttaatcacagctactggggaggctgtaggcaggtagaatctcttgaacctgggaggctg

SEQ ID NO: 14089 - DNA, 9391 bp, Homo sapiens
tgtttttaagcagaagattctttttatcaaatgaaatcttaagcagaatcccagcatataaaacagaatggaattactttgatctgattgaagtgggggctggtttcagagatcataggccatcttcttggcctgtcatggaggcctgtgaggcatctctacagaccctggtactctgtgaagagtttggaaattactgatctactttaacccccaaatctctaagttgaaaagtacaaaggggcccagagagttagataaatttcccaaggctgtgtggtaaacccacgtctccagtgtcccaggccagcaggcctttccctcaattgcctccctttttcagcaaaataagactagagctggccaggtgcagtggcttatcctgtaatcctagcactttgggaggctgaggtgggcagatcacctgaggtcaggagtttgagaccagcctggccaacatggcgaaaccccatctctactaaaaatacaaaaaaaggctgggcgtggtggctcacgcttctaatcccagcactttgggaggccaaagcagacggatcacctgaggtcaggagttcaagaccagcctggccaacatggcgaaaccttgtctctactaaaatataaaaaattagctgggggaagccgaggtgggtggatcacaaggtcaggagatggagaccatcctggctaacatggtgaaaccccgtctctactaaaaatacaaaaaattagccaggcgtggtagtaggtgcctatagtcccagctacttgggaggctgaggcaggagaatggcgtgaacctggaaggcggagtttgcagtgagccgagatcgtgccactgcactccagcctgggtgacagagcgagactccgtctcaaaaaaaaaaattagctggatgtggtagcaggcgcctgtaatcccagctactcaggaggctgaggcaggagaatcgcttgaacccagcaggcggaggttgcagtgagctgagatcgcaccactgcactccagctggggtgacgagtgaaaccgtctcaaaacaacaacaacaacaacaaaattagccagtcatggtggcaggcgcctttaatcacagctactggggaggctgaggcaggagaatctcttgaacctgggaggctgaggttgcagtgagccaagatcgtgccactgcactccagcctgtgtgacagagtgagactccgtctcaaaaaaaaaaaaaagaaaagaaaaggctagagctacttgcagttgcctgagttagagaacatctctacaaggtgtaagtgacttctcatctgctcaacagctcaaattatttattgtcaaaccatgctgtctatgcttaggcctttaggactactagggtcgtgggagcctcaaagtgtattctgcttggtccaggccttcttgggcttgatgttcatgcgtttccagacttcagctgtggtgcggtctgctttggtgaccccactgaagtcgaacgtggtgatacgggacagggtgcacagcacatattgcctgtggggaagacttaggctgggggccagcacccccaccagaatccccttccccctccactagttgctgttgtcttccctgactgcaaggaatggagggacttgagcatagtttgggaaagattaggtttatcctgactgagagcaaggaatgcttagaggtctgttactcccttcccaggtccaagcatggcagaagaatggtcgtagatttcttgtttctcctcctcctttcctttaggggagcccagctagacgctacctccaggggcagggcacttacctataccctttctcttcctccatggggttcccatggagtgtcaggctacggagccgaggaaggacagccagcttattcacctcccccaggcgctggatgctgttgccgtgaagatagaggacactcaggttgaagaaagttgttaggacctgttggggagggaaaccaaaagccaggctagacaggacaggaccctgaatctctgctcagggctgactcgtgggcagagaaggaagaatgtggggaacaacctgccctccactccaaccctccacagccatactgtatgactgtaacctacttttatttatgttttaagacatacagggcatcacactgaaaaggagctgtgatctgagggtcaggagtgtgggcctgggtaccagcactgccactgacttgcctctctcagccttagttgccccttcactgaagacctttccagctttggtgatctacgattctatcacagcaagcaacaggaagacagagcatcatgctaggcacataagaagcttttaaaatactggttaaattgagatcaccacaccaggggaatagtgtccaagtcatgctccagctcctttcccctcttagggatcttggactagaaaaggccaaactttatttcttaaaacttgaatctgagttcacagaaagtaagtgctgtactttattgactacctcttccacaggagaacccagcacaggtcacagtgggtgcgcagtgacagttagaattttacttcagcctctgatgtaccagttgtttgttgggtttcatgtattttcttttcttttttttttttttgagacggagtctcactctgttgccaggctggagtacagtggcgcaatctcggctcactgcaacctctgcctcctgggttcaagtgattctcctgcctcagcctcccgagtagctgggactacaggcgcccgccaccacgcccagctaattttttgtatttttagtagaggcggggtttcaccatgttggccaggatggtcttgatctctcttgaccttgtgatccacccacctcggcctcccaaagtgctgggattacaggcgtgagccgctgtgcccggtggttttcatgtattttcattcaatcctcacaaaacctttatgatactggcatattatccccatttttccgacagggaggctgcagttttgagaggttaggtagcttgctcaaagtcacagtcagtaagaggcaaacccaggatttgaacctacatctatctgtctggccccctagccttgtgctttggactgtaccatgctgcctcattacttccttgataacatgtaggagtggagaggttgggggctgaacaaagtggcttcaggctcccctgactggattcctactgttaggaactcacagggtcaatggaagtcaggtcattaaaggacaggtcgatccaggccaggttctctgggtgctccaacagctgtgaagccacctggttgaagtctctcagatcattgagaacattgttattcagccacagggactgggtcagtgatttccccgactttgaacgcttcagtggtcgtagtcctgtccttggctcctcatttaccagatctgtggggacaaagtgagacttgggtatcatctttgcttttttggctttagggggtgggaagggacagagctggaaagattagccatccaggctgtagctggagggtctggaagggccatagccctgtgcctgagtctagtgcaaccctgtcccacagcttccagcaatcagtaagtttagactaagggccagagacttctatctcaagctcttggctttccaggtcacatggacttctcatgtccactgtaccactgggtcttttttataccaaaccagtgtggggttgaggaaaactaagaaccagaattgttgggcttgagctgagtagatgatagcacaaaatcctgaattaactactggtaaagcctatagaattcacttcaatggaatacactttgatatcctgtctctctttccattaatgttgagtacctacagtatgccaggtactggatatacagtgataaacaaaatgagagacagtctgttccagactttgtatgaataatagggcagagagcagacatttgtgccttggaggagcttatatgggcaagatgggagcaagctggcaatatggtgtgataagtgctatataatagttgtagcagcacagaagagaggctattgacccagtatgggagctcagggaagtttcccagggaaggtgaagcctgagctgaatctccatggattaggggatgtttatcaggcaaagaagggtaaacaggcagggaacagcatgaagaaaggtatagaggtacagaacagccagggagtctggggcgggtttgtgtgcctgcacaagtgcttgcacgcactgcacaagggggacagagaggaaaaggaggcaggaatccagtcaaaagtctcaaatgtcaggctaaggatcttgggctttaccctgtgtgtaatgggaaggcactggagtgtttaaagcaaatgattcaaatcttttatttcagaaagatcactcttaagtgtcagtgtggaatatggattttagggagtgagttggaccaaatgaccaatttggctgtttgagtcatccaagcaagacatgagagggccctacaatcaacataatttggttgactggatgtaaaggtagaagaatattaaagggtggttgccagttgtattaactggtaaggaattacagaagaagaaatagcattgggaatgtgatgagttcaggcttagctttggtgtatttgaggttcctgtacaaaaaggtggagaagtcaagtaggcagttggagatgaaggtcggaagctcaggagacacagacttgagaatcattagcatagaaggcatacaagttagggaaagagatgagattcctcagggagagtgagggtagggaggaaggtcagggaggaagaagaatccattagagaagttaaatgatcagggaaaatcaggagaggacagtttaaagatgttcagggagtaaatagtttatagtagtaagttccagggaggtaaggactgaaaagtaattttggcaacttagaagtccctggtaaccttggtaagggctgcttcagtggaatggcaagggcctggaggcagaagccagatggaagtgagtgagttcaagagtgaatggaggctggtttcatgcctgtaatcccagcactttgggaggccaagacaggaggattgcttgagcctaggcgtttgagaccagcctgggcaacatcatgaaaccccgtctctaccaaaaaaagagtgaatggatataagcagttagcataaacaacatcctcagaaagtttggctgaggaggagagagaatagggaataggattatgttagaaccccggtgtatggaacaccccaaagcctcactcccactttttcaaaatgaggtccagttcccattgctgctaagcctttggttccctagttcacccctggggaaggaagtatttagtatttgcggaagctagccagctttcttcactctcttctgctctctactggaaggacaccctttgcccttccacccccacctctcctcctcctcagatgcaggtcaggcaacatccaccagatggctctctgccttaatcctagagtgagcaggacccacaattggggcctggggttgcaggagggtactggaacggcgtaccccagctcatgaattcctaatcctgcttccctccccacacctcctgagaaccctgaaacagaatgacacagatgaatcaaaattaaggtcaaaataaccccacatgaactagtgccccatgtgataaggtagcagcttggggaatgccaccaagcatggggtggaggccaagctcagagggaatcactggtgggacagagttgcctaaaacttgatgctggctggagctgctcttatcaaggatggagtggtatatccaggctgccacaggttgctgctcctctcagattccaccaatgcactacactgcctaagaatctgtaaagttccttgttcagagtaggccaaagcaggtctggaagctggaccacaaatatcaatgctttgggaactggggagcatttagctccaggaagatctgggaaactatgttcctgttttcctctctctgaaaggctgccatgtagctcttgccatgtgtcagaatacaagttagtttgattgaacttccctgtgtcatccctcaaccaccaactggaaggtgttggtaggtgtatatggtgggggacttccttaacactctaggtttgtgaaaagttagaggaactgggttgatggtagcacagattagatgccttccaaaggcactgccgtttcagattctgtaatatttattcattcaccaaatagtgtgccaggtacccccaaactctattgtatcccttaaccccagctgtaaataagtgtttcagaagctctggggaatctgaagggactctgaccttttgggcctttgatgtgcctcacatacctagcaaggagcacaatacctggcatatacatatgacgcacacacacacacacatatataaatgcttttagtaagtgctcagtaaatattgaacggttgaatgaaggatgggccatctgtaccatttacgttttgtgatgtagagttacccttggtactgcttgtctctctcccaattctgaggactccatagagggcagagctacacctcctccatcagagttagaaattcccatgataggtaggaggtatacttccttcccacctctgtcattgcacctgtcttagagatagttactattgcagctaaaaccccttgtgaaacatggattacatcagaagtgatgcagtgcacaataaagatcacagcaggtggctgtgtgctcgtgagagaacaaacgtgagttaccactgtggctgatgataacccaagtagaccctaaacccaatctaagactggtgctatttgccagcttcccgagcttaaaggcagtggctaccagttgcctgagagaagactaaagccaaataatagttctgagatagtggatgttaacgtgtattctgtgaggacagatggactgatgctttaatgaaagaccagataacaaaagccagggatggcagaacttccctaggaagaacggatgactcattgggaatatgacatggctgacagcctccctatgttccctcctgaagggactagctacccatttacaaagacattgaatggcaaaatgggagcgagtgtggacagtgttggaacctgcaataagtgtaggtgatgatggaataaacttggatttggctggaatgagtgtaagaaatttgtcagtaagtatttaaactggaaatatgccagtttgtagataagacccctcatgtttggccagtcagattaggcttgtgtctgcagacagaggagaaaggttttgcctacttgctgggactccacaggagcctgtgttttcctcctctcttcaggtaaaaacaggagaataaaactattggctgatagactggcttcccagttttcttccacttgactttcctgctgtagcctggcttcttttaaagatgatcaactactgtgatagccccctgtttcctttcagatttgctgcttaaaaaaaacaaacaggggcacatgttcttaggatctcctggggctgtatcggggcaaaatcaaatcaaacaaaaagacagaaaaaaacctctcactctcccctaccctccaaaagacagtaacaacacatctgcaagcatatgggaagaatctctttaggcttttaagtagattatggtttcttcctagggaccacactgggcctgctgccttagtgagtggagtactgtgctctgggggctgaccttgaatgacgtggatgcttctgaaggagtagtcaagagggggctcctgtaccgaagtgttcatatagtcccgtttgttcatagttcaggccatcattcaaaggtgcaagcaggtgccctgggagtctgggttcagcctgggaggacagagaaagaccagtgtttcaagtacaccggctttcaggtttccccatagtcctccatccctgctttctgtcctctactactctaggcctgcctggctgtatttccattttaagatatgaaatcactcttccttgcatccttgcatgtatagagcactttctacttctcagagcaccttcacatctcttagaactcatttgagaatcgaacacccatttctttgtctggaaaatgccagatgaagaaactgaaacccaaggggtaaaaggacttgcccagagttaagccagtgagtcagttgtagactgcagtcataatctcctgaatcctactctgagaccttttctgttactctacagtagttactgtggagactgtcttgatacccaccctctggtgacatcaactgggctattctattgcttaacaaatccttgagggcctgcaccgcatctggttggtgtctcaccacccctctcagtctggcccagctggggatttgccaccttctccgcttggcttctctgccagccccattacctttccatccaaataccctactttcagccctatcctgaatgtagccatacacatataaacatacacacacacaaaaccagagtctacctctcactcacctgtcactgatggctgaaactccaccattaggcattcattcctgtgggttcagggattgtttccggttaaaatggaaatactccctgacagggatgaacacaatgttgttatcagtcacttgcaatgtggtgtgaattgtcttatcagatcgtttccaatttgttagctaaagtaaagctgaggtttttctggagacaagggagagccatgagaatactactcacctgggatgaagagagctgacaacacactttaccaaggggtttgtatgtgaatcacacaagcaaaagacaaattgacaaggataaggacaagaacttgtcccagtcgacctcccctttctcattccatccactgctgccacctttgtattattatttgtattacttcacctgctttccaaaaggatttcaggtttacaataataacacagtcataaaacagatgatttgcagaatagtgccatccactagaaatataatgtcacaaatgcaagccatatatataatttaaaattttctagtagccaaaataagtaaaatgaagtggtgaaattaattttaataacttaattttacccaatatatcaaaaaatcattcaatatgtaatcaatattaaaacttactgagatattttacacttacagcacatcccaatttggactagcctacctgtcaaatgtacgtgactagtggctaccatactggacagtgcagattagaaagttaaaaatggaagagaaagatcagaaactagattacaggaagagagagatgtgccaggcactttaagaatctaagcctacatttagctctgaaattcctggcagccaaagcaaaaagagaaaccttgggattgcagttctcatcattg

SEQ ID NO: 14090 - DNA, 2561 bp, Homo sapiens
tttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagtttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtattggatcttcagtaacctttttatttcctagatgattgaaatataggtatttactccatttaaaccaggtgataagatgatgtaaatactcagggagggtattaacttgttacttttgctcgtttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaaggttcaattacaccacttttgtcaataagcaaaccaggtattttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccacacccggctaatttttttgtatttttagtagagacggggtttagtagagacggatcactcctgaccacgtgatccgcccacctcggcctcccaaagtgctgggattacaggcgtgagccaccacccccggcctgtattttcagagaggagagcttggtgtttttgtggtgccaagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaatttgtt

SEQ ID NO: 14091 - DNA, 2561 bp, Homo sapiens; identical to SEQ ID NO: 14090

SEQ ID NO: 14092 - DNA, 1249 bp, Homo sapiens
caagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaa

SEQ ID NO: 14093 - DNA, 432 bp, Homo sapiens; identical to SEQ ID NO: 10201

SEQ ID NO: 14094 - DNA, 127 bp, Homo sapiens
tttttatatttttagtagagacagggtttcaccgtgttagccaggatggtctcgctctcctgacctcgtgatcctcccgcctcagcctcccaaagtgctgggattacaggtgtgagccactgcaccc

SEQ ID NO: 14095 - DNA, 432 bp, Homo sapiens; identical to SEQ ID NO: 10201

SEQ ID NO: 14096 - DNA, 92 bp, Homo sapiens
tttttatatttttagtagagacagggtttcaccgtgttagccaggatggtctcgctctcctgacctcgtgatcctcccgcctcagcctccca

SEQ ID NO: 14097 - DNA, 390 bp, Homo sapiens
tagcctttttgaaactcaggaaagacaaaggttcaattacaccacttttgtcaataagcaaaccaggtattttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccac

SEQ ID NO: 14098 - DNA, 1812 bp, Homo sapiens
gggcagagtagagatgaatagttgggtatggcacaggcggctacctgttgtatcagtgggtatggtttacctcacatagggcacctacacgtgaagaaatggacaacagaactgctttgtctgttggcatggttgtcttattggaggactgcattattggaggactggtttcctcttccctaccaggacaatcctccgaagttctttgagctttttctactgcctatttttgcagcccaggtcagttgatcaggaggtgtggccttgtatttggtccaccttgagtcagatgccgctctgcttactgagtatttttatattggactcaaatcatgatatggaatcatttgtagacagcagacccaccaaaattctgctgcgcagtgacagcagggcagatcacggtgttaactgtaatcatcctggtagggagagggtatttatatactataggacagatggagagtgtgtactgctttcagaggtggaattgcaggctacctgggaggcaatgaatttccgcaacctctccaaaagcaaagatagaagacatgcctttctatctcttcacctctgatgcattcagagctacatcataatgttgcacaaggtcccctttaagagtaggtgtagcctgttagagtccaggcagggcatatgaacatagaacaagtaacttctcctacactcagtcgaaaggccacaacctccacacagaaggtgaggttcttcctgagcacaataatgtagttgccagatcttccacatggctgtatcaatgggcttgactctggagccttagatttgggcaagaacatttaatcatcccttgaaggaccaccagctaggattgttaccatgagagaatatggggaggagctatttaagaggatccaaaatgatgtgctgcagggctccaggctcattttattgtgtcagtcttatttaaaggtgtaagtttctcaagcagtgactagttcagggaaaaagaaaaaaaataaaggcataaggctcaaacaatcctttaactgacctctaagcaggtaataaatattactactttttttcttatagtttcttattttttaccttttttatgttcaactctttagtccacttgagattttttttctggtatgttatgtgaaacataaatcacatggacacttttatatggggcactgtcacgtgcaggattacaaatacctgttgtatttattcattcagtcatccattaccagttcaaggcacattgttagggaccagagatgataaacatcaaaaagaatgtgcttcttaatcggtagcagcttattgtccatttaaggagatcagaggtacataaattactgtatatacaaagcagcatgtaaaaagtgccatgtgagtgatgcgaacaagaaagaatataaaatataaggattgttttttatttttacctgagggcatattagggaactagcagtagattccttctgcctggaataagagttttcccagaagaagtgtcacttgagatgtacctacagggacaggtagcaatcttaatcatgacttgttggatataatgaacagaaatcctcttgtatcatctcaatttaaaaagggagctatccacttatcttgcttctaagaatctattctaaaagtaaactggctaaaacatataatgacctatgcacatagctattttttatggtattacttgcaatagcaaaagactgagaacaacccaaatattatcaatatggggctagtttaaaaaactatgatacatccacataatggaggactgtgcatcaataaaaagaa

SEQ ID NO: 14099 - DNA, 1812 bp, Homo sapiens
gggcagagtagagatgaatagttgggtatggcccaggcggctacctgttgtatcagtgggtatggtttacctcacatagggcacctacacgtgaagaaatggacaacagaactgctttgtctgttggcatggttgtcttattggaggactgcattattggaggactggtttcctcttccctaccaggacaatcctcccaagttctttgagctttttctactgcctatttttgcagcccaggtcagttgatcaggaggtgtggccttgtatttggtccaccttgagtcagatgccgctctgcttactgagtatttttatattggactcaaatcatgatatggaatcatttgtagacagcagacccaccaaaattctgctgcgcagtgacagcagggcagatcacggtgttaactgtaatcatcctggtagggagagggtatttatatactataggacagatggagagtgtgtactgctttcagaggtggaattgcaggctacctgggaggcaatgaatttccgcaacctctccaaaagcaaagatagaagacatgcctttctatctcttcacctctgatgcattcagagctacatcataatgttgcacaaggtcccctttaagagtaggtgtagcctgttagagtccaggcagggcatatgaacatagatcaagtaacttctcctacactcagtcgaaaggccacaacctccacacagaaggtgaggttcttcctgagcacaataatgtagttgccagatcttccacatggctgtatcaatgggcttgactctggagccttagatttgggcaagaacatttaatcatcccttgaaggaccaccagctaggattgttaccatgagagaatatggggaggagctatttaagaggatccaaaatgatgtgctgcagggctccaggctcattttattgtgtcagtcttatttaaaggtgtaagtttctcaagcagtgactagttcagggaaaaagaaaaaaaataaaggcataaggctcaaacaatcctttaactgacctctaagcaggtaataaatattactactttttttcttatagtttcttattttttaccttttttatgttcaactctttagtccacttgagattttttttctggtatgttatgtgaaacataaatcacatggacacttttatatggggcactgtcacgtgcaggattacaaatacctgttgtatttattcattcagtcatccattaccagttcaaggcacattgttagggaccagagatgataaacatcaaaaagaatgtgcttcttaatcggtagcagcttattgtccatttaaggagatcagaggtacataaattactgtatatacaaagcagcatgtaaaaagtgccatgtgagtgatgcgaacaagaaagaatataaaatataaggattgttttttatttttacctgagggcatattagggaactagcagtagattccttctgcctggaataagagttttcccagaagaagtgtcacttgagatgtacctacagggacaggtagcaatcttaatcatgacttgttggatataatgaacagaaatcctcttgtatcatctcaatttaaaaagggagctatccacttatcttgcttctaagaatctattctaaaagtaaactggctaaaacatataatgacttatgcacatagctattttttatggtattacttgcaatagcaaaagactgagaacaacccaaatattatcaatatgggactagtttaaaaaactatgatacatccacataatggaggactgtgcatcaataaaaagaa

SEQ ID NO: 14100 - DNA, 155 bp, Homo sapiens
tgaggtcaggagttcaagaccagcctggccaacatggcaaaaccccgtctgtattaaaaatacaaaaattagccaggcatggtggcgggtgcctgtaatcccagctacttgggaggctgaggcaggagaattgcttgaacccggggggtgggggt

SEQ ID NO: 14101 - DNA, 760 bp, Homo sapiens
gtgttgtaacaactggtgacatttcagttcatgtgactactatgacctaatcactcagtctctcagtgtcccaattccagattcttgggtgacataatattagactcacatattattagactaactaatattagcccaccatggtacagcatgctgaggctggagtcagaagtgagcagaatcctgtaatatttccaagagggaatatgggcagacaggcaatggttagcacatcaacttcatcaagtacttcaaatattttggtttctcaataaatatatacatgagttaataaatctagcatatttagtaaacaacttataatcctacctactgttgtaatgctcagtaaccacttcagagtaacagtaataatagatgactttatactaaatgatggctttacactaaaacaggtttctaaaactatctgtggtaagaaccagttttcttatttgtatttccaaatagtctccataggagaatgatgtttttgtaaaatatgctaaaaatgaattccttgacaaattaaattttaaaaagatatgcaaaattgaaaaaattttttttgttattagattcaacagacagaagattgctacgtcaaattgctctaggtttctaaatgcttagtctcaatttctgtactgatcacacaccagtaacagttccatactttaaatagcactgtactaaaactcacttatctaaatagtaaattttataataatgatggtcaattaatggcatttaatattct

SEQ ID NO: 14102 - DNA, 155 bp, Homo sapiens; identical to SEQ ID NO: 14100

SEQ ID NO: 14103 - DNA, 759 bp, Homo sapiens
gttaaatatgcatgtatgcactattggttaatattttctattttctaataatctacaggtgtctgtagttaacgttgagtcatagtgggacttgagaagtggtgcatagccagtaagctgacttttcccacccataaaaatacatgtgttttgttcttgatactatgtgtgtgcacaacaatgggaaggccattgtcagccccccaggagggacacaccgcctgctgttccatatgaacgatgcttgctgatcctgtgtgtggtcacgcagcgcagttctaccttcccatccctgtgcaggtgactgtcagttctttaaattcacttcaagcagaaaaagcccaggaccccagaacagtaacatcacatccctgtttatataagcctgaagcaagacaagcgtcaggaagaaaatttccactttaccttttttctattaataaagaccttttaagtaaaatctctgtagtgcaagttggcatgagcagacttggtaacttgtctttaaaggagaggtttaaattggaacttttaaaaactagaaaacaacagattgataaatcaattttgtattcgctagatgaagaaggtgctgtattattcccagggataataactctcagaattaatcaggctaaaaagatacatttataaaaatattacagttttatatattaagcctaaattcgatgttttgatgtgtaatatgggataaaataacatactgttcagtgcatgaaaatgacagagaaactaaat

SEQ ID NO: 14104 - DNA, 394 bp, Homo sapiens
gaggacacaggtttcctctaggttgccaaaagtggatgatgaccccagctcagcccagctgtggatattcgctctctgaaaacccctgaactgtttgctctgtgcaatttgtcccaaacgtgatcaactgtctggctctaagacctggtcttggttggcacctcatgattattcccagatgttctgcggagttttgccttgttagagtctaacctgactagaaattcaggctccccttccagctgggctgtgagttgtgtgcacaactggggacaccatagagagagcttcacagccaggagccaaggatggtgtgaagaggctgtgctctttccacctgcatactgtctgctgcctgaggtctgatgcaccatgtgtgtgcctgtgcatgtgc

SEQ ID NO: 14105 - DNA, 25806 bp, Homo sapiens
agaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactggtgaggaacagtgggcggcgtggggagggtcttttctgcgcacaggtcgcaccccaaaccgccggtcccagatcacgggtccccgatccccgcggcccagcccggtcctccgcccctcggcatcctctggctgagaccctgactccgggtctttgctctagcagtagccgatccccgatccctccgccccccactcgagtctgcccagaccccatctggcccctggccctcttcggttgtcgtcccgcagtcccattccggagtctcctgtctccgccccccgaattcccgcagccctccccgtctccgtcagccccgggtcccacccccctatcctctggtgtcaaccctgacagcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaaggtgagggtgctgcgcgctggcccttaaagcctcggtgggggacagaatgtgttctggctgaagcagagatagccagggaccagacacttggttgaaggaaacggccccataactgcctggtgttcatgcccaccaggtggctctgtttggggtccggcccctcattaattctgatgttattcagctaagcacctactcctcacagccatgttaatccggactgctgctattttaggattctgctggaggaaggacgctgtgtatcgagaaaagataagggtgctaggtatcacagttagctggcctcttctaaggatcctgtgaaatacggaaaagcttctttggggcagactgattaatggagaaaaaggaacttttaatatgactaggttttaaaagatatcttagagttctatggtaatcggatgcgtattagagaagaagggaatctgtggcattttaggtaatcggaagaccgttccattgccacccgcagtacaacagtcggaatgtggctcttggaaccattataggtgtgcctgacagaggcaaggttgctttgttcatcatcatgctttccggccagatagacagcagacgatgggagggtcctatgggccccatagtttatcctgcccattcttgtctccagtaaaaattgtgaagtgtgaggacaggactggactgtatcacctgctttttaccctaacaatgatcaatgtaccccaaacagtccttagtaacagcatagttcatcaaccccaaggtcttttgagccatcttgaaggtcttatatcctctctgtgctatcctgtctgtgctattccctggctgtgatgcattccagatgtttactgcaccgcctatcagaagcacttcctgttagatatctgcgtgttacctcctgaagaattcaggcactgggatttggtgaaaaggtccaagttccccgctgtgcatcggaccatactctgcttctgcaggtctaggctgaaaagcctcatccttgtggccaaatgttgcctttctctgagtgttctcttactgttttgcatctctcttgagttttagaagctgtagggtgattttgtagaaggttggggacaactggttgtttccagatttcaccttaatggtactctttgctgggttggctcattaaagccaaagttatgcacacgacagaggccttatatgcagccttttctctgtcatgttgctaatggcacaaagagcattaagcttgagtgagtcttggtggtttttcttttagcacattgccctgtacttgctttctttgaagcacacataccaccttcccaccactagacccatcagatctagaaagctagatctccgaaatctagcactgcatggggtgtgcttagctgtggctcagaaaaatgaaggatctccccaaggctacccagtttagggtggcagagctgggactaccccacctctgttgatgccaatataaaatgatgccgtgtcatttatagtttttatcctttgttttacttcagctgtcataaggagcaatctcataattatttcactttggtgtgcatccttgtcgaaggcatgttaaaaataaaagtaaatttttgagccgggcgtggtggcaggcatctgtaattccagctacttgggaggctgaagcaggagaatcgcttgaacttgggaggccgaggttgcagtgagctgagatcgcgccattgcgctccagcctgggcaacaagagcgaaactccatctcaaaaaaaaaaaaaaaaaaagaaaggccaggaactggctcacacttctgatcccagcactttgggaggccgaggcgggtggattgcctgaggtcaagagttggagaccagcttggctaacatggtgaaagaaaccctgtctctactaaaaatacaaaaattagctgggtgtggtggcacacgcctgtagtcccagatactctgaaggctgaggcaggcgaatcgcttgaacccaggaagtagaggagttgcagtgagcccaagatcacaccactgcactccagcctgggcaacagagcagagcaagactccatctcaaaaaaaaaaaaaaaagtaaattcttggtgcaggttcttctttgttcacatgtgtatttaccctttctaagaaattattcgggccaggccaggcatggaggctcacacctgtaatcccagtactttgggaggccaaggcggatggatcacctgaggtcaggagttcaagatcagcctggccaacatggtgaaaccccatctcaactaaaaatacaaaaattagccaggcctagtggctggtgcctcaactacccaggaggctgaggcaggagaatcgcttgaacctgggaggtgaggttgcagtgagcccagatcacactactgcactccagcctgggctacagagtgagactccatctcaaaaattaaaaagaaagaaattattcaggctccgttttgtcttttgcaaagcatgttttcttaacctttacattacatttgctcacatatttagagaccttaacctgtgtatagtttctacttgcttgcctgtggccatctcctaagagcagtttgtgcccattaataggagagttggcagtggtgcctcatgagctatcacagaagaatcagtaaggaatccggaagtccttgattgcatcttctctcccttttctttgtacctactggttttttggtacccagtgggccttcagacatgtagtatcctgtgtgactgtgctgatcctcagggcctaacagatatcctgacctgagagcctggagtattccacatctcaagagggagcagagctgtcaagcacagatgtggtgcatatagagtttttttttttttttttttaaatgagacagactcttgctctgtcacccaggctggagtgcagcggcgccatctcagctcactgcaacctccgcctcccgggttcaagcaattctcctgtctcagcctcacgagtagttggaattacaggtgctccaccatgcccagctaatttttgtacttttcgtagagatgaggtttcaccttgttgaccaggctgatctcaaactcctgacctcaggtgatccacccaccttggcttcctaaagtgctgagattacaggcatgagccaccgctcctggccacatgtagatacttccagagggagaacagaccctgccaggtctctgccggtgatgggagttgggcagccagcaggccctggagcagccttaccatttctcagcccctgcctgagtgccacattttgacattatgctaagcacaccccatgcctgcttttttcctcctaaacagcatctttatttggtaggtactgtttcagccccacttcaaaaggtcccagctcagggaagctaggtagtttgctcagctaatctgagtggacattgactccaaagtccatactcttactgcaacaccttagtgagctccgagtttatttcccatcaaagctgcctgaggcttatcactttcctattctagttgagttttatcataagcccagccaaagctgtgctttttgtcataacttcatcgcctcagtgttgaggctttagttggtgatcccagggcaaagccactctcccattgtcattcacaaagcttcagaggctttagccaatgaaagctggctccaaagaacccatcctgggctgggtgtggtggttcactcctgtaatctcagcactttgggaggctgaagcaggaggccagcaggatcacttgagtccaggagttcaaggctgcagtgaactatcgtcgtgcctctgcactccagcctgggtgacagagtgagacccttcctttaaaaaaaaaaaaaaaagacctcatcctgggttttctccactgcccctgcaagcggtgcctgcttctcacacagctctcaacctggccctgggtggagatagactcacacctctagaccccagaaagaggggccgcagatagtcatttcttctgagcctttctgcctctcaagtgtggccaccaaagggcactggcaacagccccaggaagcatctttggagaatgaggaagttggggagtagaagtcaggtgaatcacaattgacagcagccactggaagatcaagggccttccagggagagcctgtgtgcctgataggtggtgactggggcagctgacactgccaggccctgcggggcctgttggtgtctgtgggataacctggctgggcactagagggctctgttaagaggcctgtgtcgcaggcctgtctggaagctaaaaaggtcacagtgaggagacgctgagcaggttgcacagatgcataaagagggattggggcattggggaagtgtctctaattcagagggactccagcaagaagggaggcggggtgggacagaagtccttttaagcctttctgcctgcagactgtttgggtcaggagtggttagagcaatgggcagatagacaggaagaggcaggaccttcaaaacaaatctagcctggtgactcaccagtgaccttgagcaaagtcagttccatgggatcctattacagctgcctacttccctgatgactagagggcaccgccaagcagtgtttaccaaaatcaacaggccagagcacagctggaaggtaggaggtgttctgtgtctagccagggcatcgtggactgcaccactggcttgaatttcaagttagggtcctgcgttgcatgccatttctctctcgaataaaatcctacatacataaccttcaggggttttctttagcaatcccctcatgggagcaggtgcttgttgccttccctgctgtaccgacgtctaggaagggaggagagaaagacattgagatactgactccagaagagtctctgagctgggctccaagcctgtctaggataactgcctgttcttccggtgtgctctgagaccctctgaggaaaacccacctgttacatggggcaggcccctggggtatctgttaacgttacccaaagggaatttcatatttggttttctcactaaccctgagggtttactcacagctttggagtggggaaaggcagttatattgaaacaaaacctattggagttttaggtcaaaagtctcttctctctatcatattgtcatacttgtagggtaggcccttagtctggctttagtaggccttggtccacacgggctgacgtgtggtcaaggaagtcttggtagaagaaggaaaggcatgctgaggtgacacactggcccagctgaaacagcctctggttaataacagcacaggtggctgctctttcatgggcacggtgtcagctgacccagcatgccctggtggtgggtggggcagatgttattgttttcatttgatagatgagagaacagaggtccagcgcactcaagggacttgctcaaagtaacacagtctctgctagagctaggattcggcgccaggtcccaagcctttccggtgtcctgaccacttcctagagcaggctctgatggttgcaatgctgcaggagcttagacaccatgcctggcaggttttgcccaataattccccatgtgaggacttaatgacccaaaccttttttgcttcttagagagatttcattgcttcaagctgttcctctagtgagcttagcagctggctctgaggatggctccaacagtattcctgttagcttctgacccctcattcacgcacaactctttaggaattgattgattatctccagggaaaaatacagtggccgagtctggtacttagtgattccgagcagcacagtgtaggggagcctgatcatggtttggaatctagctctgcagcgtgtggcctggaggaagccacttcaccttctggagcccccgactcctcatctgagctgtgtggtaaatcccccaggggggcacttcacccatctgtgtgcacaggctgttccaggaggggtatacaaggcccctccaacaatatttgcctttggagaggagcaggtggacatccgcaaggggagggatgtcctcttggaagctttttatcatgtgcatgtctccttactagtaaaattcatgtataatgaaacataagacaataggagtatatgtcatggatgtacatttttaaggataatcaaatgaacatccttgtgctcaccatccagccaaagaaacaatacaggctccttgaagcctgcacatattacttttcttactccaactgcctggcctcatcagtaatgtgagtggaatctgacacggcctactgcagagcggcatgtgacctctggtaggttattcttggaagcactataagaacactgccccatccctgccacatgccacgtggaccccaagaagaactctcttagcttttaataagatttaaaatacagccaggagatagcccctgtctcctagagcttttctttcagtgaggccccatgcactatggctctgcagggctgggttcaatgaaggctggtcccagttgctggcagggttcacacacaggcaggctttctggcagtagacagttacccaggctggatgcttgggcccaaaacagatggtcagcagacaagagatcatgacagatagttctgagggctgcttcgtgggtgacccaaagccagacagaggtgtatgagccttgtctgggcccagccagcctctgctgggcgaactctgagcctgaggcagggtatgcgtgctcaatcctagaggctcagggcttctctctacccagaacctgtgatgctggcatctgttgggctgagtcagctttgctgggtttaggtcccctccccaggttcctggactttcccccatcagtccaccttcctctgaggtctggaaccagtgtttcttgaagtgtggggcttggatcacctgcatggggattacctgggctgcttgttaaaatccagattcctaggccctgctccagacctagaactcggactctctggggacctgggaacacgctttcagccagtgccacagtgatttgggtatgccctagagattgatgatcacaccccacaccctctcagcctgagatcaagttcaggaaaggacgctatatagcctgagtcttgccagccctttccaaattttcctaaatcacttggtgacccatggcctaaataaaagaagaacttgccagtggctgtaacagaagaaggagaggaagttaaggcccatttcctacttttttttttgaggcggagtcactctgtcaccaaggctggagtgcagtgatgtgatcttggctcactgtaacctccacctcccaggttcaagcagttctcctgtctcagcctcctgagtagctgggactacaggtgcacgccaccatacctggctgattttttaaatttttagtagagacagggtttcaccatattggtcaggctggtctcaaactgctgacctcaggcgatccacccacctcggcctcccaaagtgctgggattacaggcgtgagccaccatgcccgaccccatttctactttttatgaaagcttaaaatacttaatcatggcctggtttctttttggttcagcctttattctaccctatgcttctgggagcttttgcagtttgcatagttatcaaaggagacagacagtatcatctagttttttgtttttttgttttgttttttgtttttgagatggagtctcgctctgtcgccaggctggagtgcagtgacacgatgtcggctcactgcaacctccgtctccagggttcaagcgattctcctgcctcagccccccgagtagctgggactacaggcgcgcgccaccacggccggctaatttttgtatttttagtagagacggggtttcaccatgttggccacgctgatgtcgaactcctgacctcaggtgatccacccgcctcggcctcccaaagtgccaggattataggcgtgagccactgtgcctggtagtgtcgtctagttgaaatgtttttttaaagaatggctaaagtactggagggaaatacaagttgctgtgtgtctgctgcgtggttgttgtcatgggctctccctgcaccatgacccccaggaaccccttgagtgctgtgtcttttctttcagcctcttccttttccttcatttatgcccttgacgtgtgcacgttggcactgtccaaggcttctggggcttttgtggtataaatgtggtggcttcctagcttttcctgttgatggcttgtccccagctctgccgagtctgctgagtcccttttaggtaggtctatttccctttactttccagtttttggaaccttgttttatacctccctttctttttgtgtgggttgccttttaaaagaattcttttgttctcgtagagttcagggagggagctaaactaaatgtgatatagtctaccaactttcctaatctatgtaatactttcttgtagctgcacatttctctaaactgccgcaacttccttcttcctcttttctttattttacttttttttaaaattgtggtaaaatatacataacataaaacttagcattttaactttttttttttttttttttgagacagagtttctctcttgttgcccatgctggagtgtgaaggcgcaatctcggctcaccgcaacctccatctcccaggttcaagcaattctcctgcctcagcctcccaagtagctgggatcacaggcatgcaccaccacgcccggctaattttgtatttttagtagagacagggtttccccatgttggtcaggcttgtctcaaactcctgacctcaggtgttttgcccgccttggcctcccaaagtgtgggattacaggtgtgagccaccgtgccctgccaacatttttttttttttttttgagacagagtctcactctgtcaccaggctggagtgcaggggtgcaatctcggctcactgcaacctccaccttccgggttcaagcaattcttctgcctcagcctccagagtagctgggactacaggcgcatgcgatcacacccagctaatttttgtatttttggtagagacggggtttcaccatgttggccaagatggtctcgatcttctgacctcgtgatctgcccgcctcggcctcccaaagagctgggattacaggcgtgagctaccatgcctggccaatattttgtttttttaagagacagggtctctctcggtcatccaggctggagtgcagtggtgtgattatagcttacagtaactcctgggcgcaagcagtcctcttgcctcagcctcctaaggagctaagactataggcatgcgccaccatgcccagctaattttttttttttcctcaaagagacggggtctcactatgttgcccaggctgatctcagactcttggcctcgagcaatcctcctgcctcagccacccaaagtattaataaccattttaagtgttgagttcattgatattaagcacatgcatcatgactatctgtttccaaaactatcatcatttcaaactgaacctttgtgcacattaaatgataacttcctgttctcccctctccctacctgctggcaaccaccattatattttctgtctctataaactgattattctaggtatctcatatgagtggaattataaaatatttgtcctacatttggttgatttcacttagcatagtatcttcaagttcaacttctttttggaacaaaaagggaatgaatgagtgagtaaatggagaatcagcattaattgacctgtatggtcttagcctctctggctgtctcagctccaaagtcaggcttttcctgccagctcaaaatatcctttagcagaatgcattaacatgtcaggttaactgtcagtgtctttaaaaatggttagaagggcatggcatacacagtgaagtagaatcctgcacttaggctagtcctgttggaaagagaaggacttgaggtacaggagagcagtggcctctgctaatgtggaatttgctccagctaccctgcagaccacccaggagcaggggctaagacagcgtcctccagaactgccctggctcccaggactgtggtggaggggaatcaaactccttctaggtggggacttcctgcaccaagtgttacttggggccgtgaaaatttggttctccctctacagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacgggtaagccgtgagcctgctcacagtgggagaggaactgctacagggtgggggcatcctgtctgagttgccggtgggggctctggtttctctgagcaggcacccttccaggagctcatgtgccaagctccagtctttcccagagtgtcagggtgtcagcagcctgctccagtctagctgctaacttgccaggatcacaaacccactcagcccagctgtagaggggaaatgttgctagaaattccacaaggaagctcacagctctctaaaatggcatttgaagctcagacctgacatgagtgaagaaggaaccaggcagtctcccgtgtctcccctggagctcctggtcagattctctcctctccaccttcctgcttccctacagacccgccttttcttgtatgtagctgctgtcctccctcgtgcctgcactgctgtgctggtttgaattgtggtgtgcctactccagctcccaagctgcatgaccctatttgctccttaagacagatggaatctgactggcctagatcaggtcagactgctgtccccaacctcaggccaggaatcccatggtcaagagagctcctccttgcagagtctggggccaggcaggttctctgagaatggggtttgggtagagaggctgtgattgggtcctcaagcatcctagctgtggagtgctcactaattccccttctgtgctgtccctctgtctcctagttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaaggcactaacagcagaaggagcccaggaaggattttcagaagggaagggagggatgcaaccttattttaatgactggtgacagtaggaagggttctgcctggccttaagtgagggtgttgaaagtgggagacaggacctgccaaaggggaagagggcggtcacagtcaatcccagggcccagtgtctcagccaggtgctggagttgggaatgcgggagccccagtctctgcccacctgtcacgtggcagctggaaggtggcatcaactgcacaggcgaagaggggcccgcacacgagaagccatgggatgtgaagggccgcaaggagaggaccctgggacacaggaagaggtggtgcatctggggcagggcggctttcccaagatgactagagaatcttcagctggcatcttgcctgaaatatccacgctctcagccactacactaatggaacacagatgctatggggagacagaagggaactgacaaacttcatgcccctgttttcaaatagcctgcaatcttacctcttcctctgcattttttggggggagtgacattttaatgggaggcaggaggtttgtggagaagagaaaatgttttttttgtgggggtgggtagagacagtctcaccatgttgcccaggctggtctcaaactactggcttcaggcaatccttctgcctcccttcccaaagggttgggattacaggcttgagccactgcaccaagcctgaaaatgtcgttttgaatgagcccacctgaaacgaagacgcttcattagggttactggtttgagaattaagatcagttctggccgggtgcggtggctcacgcctattatcccagcactttgggaggccgaggtgggtggatcacaaggtcaggagatcgagaccattctggccaacatggtgaaaccccgtctctactaaaaatacaaaaattaaccaggcatggtggcaggtgcctgtagtcccagctactcgggaggctgaggcaggagaatcacttgaacccgggaggcagaggttgcagtgagccgagatcatgccactggactccagcctgacagagtgagactccatctcaaacacacacacacacacacacacacaccacacacacacacacaggttcctcaccataagctttggggaaaattcttggcttttttgctgggggagagagcagtgcccagggaagattggctgatctcagagctggagggtttatgcgggactggccagccccttcagctgagtgggacagcaacacagtgggtggtaaggggcttcataagatgtacaagatgagggagaggcccctccagccaaccctgtgtctaaagagtcaggtaacgaagaactttccagagacagctgtgagtccgtctggcttaaggggttgtacaggtgtctgagaatggggcctgaaggtgcagggcctgcaggctgccctgtttggaaggttcctgtccttctgtcttggtagaaaatggcagctagccttgtaaagggcctccttgtgtagcgagatagaccatgtagccccagatgcccccatggcttcacttccctcttgggggtctctcagtatatgtctagtgccaccactattggtggagagtttccttctggaataaccttggggtggtggatgggttttattttaataaaagaagaatgtctcattcattttttcttatttattttttgagacggagtctcactttgttgctcaggctggagtgcagtggcaagatctcggctcactgcaacctccacctccccgattcaaacaattctccaacctcagcctcccaagtagttaggattacaggcatgcaccaccatgcctagctaatttttatatttttagtagagatggggttttgccatgttggccaggctggtctcaaactcctgacctcaggtgatccgcccgtcttggcctcccaaagtgctggggttacaggggtgagccactgcgccctgccccgttattgattctttccatctgtttgcttcctcatattctaacggggtatgggaaatttgcttgcatgtacacacatgcaatttctttcctttttttctctttttctttctctttctctttctttcctttctttccctcccttccttccttttcttttcttttttctttcttttctttgacaggatcttgctctgtctggaggctggagtgtagtgctgcaatcatggctcactgcagcctcaacctcccaggctcaagtgatcctcccaccttagccacctgagtggctgggactgcaggtgtgagccactacctctggctaatttattttttgcagagacagagccttgccatgttgcccaggctggtacacacccaatttctattatgtgtacaggcctgtgtctttcttcttgtttaccttatcagtccattaggccaggagtcgtgttgttgtttttatttttttttaaggtggagtctcactctgttgcgagtggacaagagtgcgctctggagtgctggagtgcagtggtgcgatcttggctcactgcaatctccacctctgggttcaagcaattcccctgcctcagcctcctgagtagctggaattacaggcgcacaccaccatgcctggctaatttttgtattttttagtagagaatggggtttcaccatgtttgccaagctggtcttgaactcctgacctcaggtgatccgcctgccttggcctcccaaaaagctgggattacaggcatgagccaccacacccggctgggtcacgctttttaatgtgacattcattcagcaaatacactgaacacaagtgccttgtggaggatgcagaaattctaacacatatgatccttgccctctaaggccttccaatccagccaccaggaaagaggaaacctgatgacaccgaaacgtgatagccaaggaacacttcctaaagaagagacttgatctgggccttggagaaggggcaggccttcatgagagcatggtgtaggcagtggtgtgaaagcaggaaaggaagggcgtggctttggggaacactgagttgatgtgagcagctccttcccactggaggtgcagggcaagcaattagctcatggacctagcccaggagggcctggaacatcaaggttgtcagaatgttcacagctgcaagacccagaactgaaaatttcttaactaaatggaatttattgttttccacaattgaaaagttcagcgtagtcggggggactgggctgggtccagggactcaaacaatgacacaaagacacagtttctctccacctctttgctttgtgtgtctgctcaggccatctctccccaaaggtggtgaagatggccaccagcagactggggctcaccctagactcctttttaaggtaacaggatgactctcttttgcccaacttagatcatgccccttaccctgaaccctggcaaagaacgtggagcttcctcctgtggtccaggtagaggatggttacatgtggggtctgggattcagaggtggcaccgctggcagtggttgggacatgtgagcacaagggtgaggcctacaccactctgaggccttggctgccccttctctctcccccagccctcgcctttccatgatggtaagacatgaggccactcaccagctctgccttcttgaagaaaatcagtgtcctatctttgaacagagctgggccttgaagtcaggctcacccactctcaaaccgtgggggaaacagagccttggttacaccagctctgtctcagggattgttttttctgcttctctcctacccttgcccgtttcttcctgctcctttccagcaccctcccagctcctcactttcctgacttttgttttcttttccaagcagcttgagcagtgcttgatgctcctgggtcacagcgtgcacacatcctggctgttctgggtaaccgcacacccaaccccagtcccatccccatatctctatcctgaaatcaacccaaagggtggggagggagcaggcaacagcagacaacagaaggcgggggtactgagagcatgtgctgctattcaggtaccctttgcagtaattccccagaagcactaacatttctgctgatcttggaatgatgctgtattactcagggttctccagagaagcagaacaataagatgtggagatatatgtatatatacagaaagacattataaggaattggctcatacaaatgtagaggctgacaagtcccaagttctgcagggtgagtcagcaagccgagacccaggagagccgaggttgtagttctagtctgaaggccagcaggctgaagatccaggaagagctgatgtttcagttcaagtccaaaaacaggaagaaagctgatgtcaccacttgaaagttggtcatgcaggaggggcgccctccaactcagccttttgttctatttgggccctcagctgatggatgaggatcccctgcgttagggaggcagcctgctttacttgctccaccaacataaatgccagtcctaccccacgccctcacagatggacccagagtaatgttcaagctgatatctgggcaccccatggtccagtccaactgacacataaaattaatcatcacagatgccttcttcagcacatgctcgatatctaacaaatatctctacggtgagattttccccccaaccttgggcccacttaagaaagatgttgaactgggcgcgagggctcacgcctgtaattccagcactttgggaagctgaggtgggtggatcacttgaggtcaggagtttgagaccagcctggccaacaaggtgaaaccccgtctccattaaaaatacaaaaattagccgggcgtggtggtgggcgcctgtaatcccagctacttgagaggctgaggcaggagaattacttgaacctgggaggcagaggttgcagtgagccaagatcatgccactgcactccagtctaggtgacggagcaagcctccgtctccaaaaaaaaaaaaaaaaaaaaaaaaaaaagaaagatattgagaaattggagagggtccaggcaagcattctgagtggatgaaaggttaaaagttctagagaaaaggatgtaatagcaatcttaaatgtgtgaggagataattatttatttgctcaaatgtgtgacttaaaaaggcacgccttctctataggactgtttccttatatgtaaatgaggggctgaactgggtgactttacagtcctgccagccataaagatccatgacttcctgagagggggctgccacgctctgtatccactgtgggagatgaagaaggactgaggaactgagcagtttagctgtagcctgtagtaccagctacacaggaggctgaggcaggaggaccactggaacccaagagtcttgaggctgcagtgcactatgatcatacctatgaatagccactgcactccagcctgggcagcaccaccagaccgcatctttctttcctttcttttttttcttcttttgatggagtttcgctcgtcacccaggctggagtgcaatggggtgatctttgctcactgcaacctccatctcccaggttcaagtgattctcctgcctcagcctcccaagtagctgggattacaggcatgtgccaccatgcccacctaatttttgtattattagtagagacaggatttctccatgttggccaggctggtctcaaactcccaacctcaggtgatctgcccacttcggcctcccaaagtgctgggattacaggtgtgagccactgctcctggcctctatttatttacttacgtgagtttttttttttccaataggtttttggggaacaggtggtgtttggttataggaataggtcgtttagtggtgatttctgagattttggtgcacctaccacctatgcagtgcacactgtacccaatgtgtagtcttttatccttcacccccttcccaccctttaccctgagtccctaaagtccattgtactcatctctattaaaaaaaaaagaaaaaaaggccaggtgcagtgggcagatcacttgaggtcaggagttcacgatcagcctggccaaaatgctgaaaccccatctctacttaaaaaaaaaaaattagccaggcatggtggtgtctcggctgtagtctcagctactcagcaggctgaggcaggaggatcactggaacccaggaggcagaagtggcagtgagccaaaattgagccactgccctccaggctgggtgacagagcgagactccatctcaaaacaaaaacaaaaacaaaacaaaacgaacaacaacagcagcaaaaaaaggccaggttcagtggctcacacctgtaatcccagcactttcggaggccgaggtgggcagatcacttgaggtcaggagttcgagaccagcctagccgacatggtgaaactccggctctactaaaaatacaaaaattagctgggtgtggtggcttgctcctgtagtaccagctactcgggaagttgaggcaggagaatcacttgaacctgggaggcagaggttgcagtgagccaagattgcaccactgcactccagcctgggggaccagccagaccttgtctaaaaaaaaaaaaaaggaaagaaataaattcttttcccatctttctttctttattcttattttttgagacagcgtcttcatctgttgcccaaggtagagtgcagtggcacaatcgcagctcattgcagcctctatctccttaggtttaagcaatcctcacacttcagcctccaggttgctgggactacaggtgtgcaacaccacacctgactgattttttttttttcttttctgtattttgtagagatgtggttttgccatgttgcccaggctgctctcaaactcctgggctcaagcaatctacacacctcaacttcccaaagtgctgggattaccaccacacttggcccttttctcatttctaaagtgggttgtcttttattgttgagttttaagagcttttgtttgtttttgccatcctgtgccactctgttgcacaggatggagtgccgtggagccatctgggctcactgaaacctccaactcctgggttcaagtggttcttctgcctcagtcttgagtgagccactacgcccgcctaatttttgtatttttagagagatagagtttcaccgtgttggccaggctggtctcaaactcctgacctcaggtgatccgcctgcctcggcctcccaaagagctgggattataggcatgagccaccatgcccggctgagttttaagagtttttatatattctagataccagccccttatcaagtggcacagagcaactatggcagagggcctacagagattaagtttgtgccccatagatatacactaaaacattttggagaaatggaaaaatatggattgatactttccattgcaacagaattcttttaaaagacaaaagaaccttagatatcctcaccaaatttcaggatgaagaacacagatattggaaattcttgctctaatcttacctaagggtgtattagtcagtgctgttttagttgcaaaaactaaaaactcaactcaaattagtcatggaagaaaggaatttattggctgagcagcggagaagttaaatcctgaggtgaatttggggctcccaagatgtctgggcctcctcactccccctcttccagctccacccctgatcactggcatcatttcctggccaggcccttctctagccttcagtgtggcaagagagcagtttcatttccggctatctcagagcactgcattcaacagaaaacaaagcaagccctttccttggagtttacaaatgactcaggattcactctgatttgaccaagagtcagaaccctaattggccaagcctgaagtcacttgtctacccctgatactgggaatagaatgcatggatgagagggaggtgggtggttccatgaaaaggaaattcaagcacttttcctaaaagaagggggaatggatgctgaaacaacacgtctcccacaaagggagcagacactgggcttgtgaagctgccccataccttccccacagaactgggtttccctccttggtgcccctgacggagccttgtcttcaccctccattatgtattcatcatgtggcatcgtcactgtttcctcctctgtctccagagtgtcttctcttagttctcagctagtaagagaaggaggctgggcatggtggctcatgcctgtaatcccagcactttggaaggccaaagtggaaggattgcttgaagccaggagtttgagaccagcctgggcaacaaagtaagactcccgtctctacaaaaaagaaaaaaaaagttagctgggcatggtcatgtgcacctgtggtcccagctacttgggaggcagaggcaggaagactgcttgagcccaggagtttaaggctgcagcgagctatgattgcaccactgcactccagcctgggtgacagagtgagacctcatctataaaatttttttttaaatgcaggggtgaaggaaataaggaggtaattactgaaagaatgaaaggtcatgctagaaatataccataaaatgcaatggggactcaaagaagggcaagattaaaggggacaggaaatctattctggggtgtctttgagggccctgagaaataaaacaaaggagtggcaacaggaaccaaaatatcctcttaattactgctagagggctgggctggaggacacagctttagacctgtgaactaagtgagctgctaatgcaaatcccactaggaggcaggctcacccgcccagccatggtagccctcaaccagagaaagcctcctttagtcctgcaggagtgcagccccctcagcgagagcagtgggattttataccctgcatgcagctcacccccaaggtgatggaggggcccactggcctacacaggaccagtttcccctccccacctacctatccaagcagtcatcttttattttccctggggcaaagtaatagaggggtggagagaaggcaggaatgttaccctagtggaactccctgaacaggggaggaaactggtaaggtttccaaaagctcatggagacagtggcatttaagatgggcctctcttaaggtcctgagcaggaggaaatgcagagactctgggccaacactcctagatgtggcttctggtcacccccactgtcaaggtggctccactcttgccccatggctctctgtaataactgccctcttgccttgcctgctggcctgggttgctatggtgcagtaactctacagcttggtacttgggtctcgacttgttcatacatgttggtgcatctctgtgccctaagattctcttccagctatagctggctctgtttctctgcacctgccacactgcaatgagcagatctatttccaggtctggcagcccctgctgctgggctccttcccatagtggtaaactgggccaggctgaagagatgatattaacctaaactgagccagatactcaccaactgcagggaaggaaggaagcaggagtgtgtgcttcactttgcttcctaggctccagacccccaactgcccgctgggaaaacaagggcagctcttgcccacatgaagcagggagcctcgctcctgaggcagggcgctggtggaggctgcctgaatgtgtgttctcactggcgacttggatctggtcctgagaagagttgacccgagatgtctttggccttgcaattccacatacagccccctccttgatgacaaaaacagatgcttccatgaggagtttttgaattcggaagaaattacctgctacgaggaacagtctcacatactgaggagtaagaggacgaatattgtaaacacttttcattctgaataatagactaatagagctttggattgtccatgtattctgaagggaagaaaaggcacttatttgctgccttttggcatgatagtcaaagcccaggggttgcatcagactca

SEQ ID NO: 14106 - DNA, 20835 bp, Homo sapiens
agaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactggtgaggaacagtgggcggcgtggggagggtcttttctgcgcacaggtcgcaccccaaaccgccggtcccagatcacgggtccccgatccccgcggcccagcccggtcctccgcccctcggcatcctctggctgagaccctgactccgggtctttgctctagcagtagccgatccccgatccctccgccccccactcgagtctgcccagaccccatctggcccctggccctcttcggttgtcgtcccgcagtcccattccggagtctcctgtctccgccccccgaattcccgcagccctccccgtctccgtcagccccgggtcccacccccctatcctctggtgtcaaccctgacagcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaaggtgagggtgctgcgcgctggcccttaaagcctcggtgggggacagaatgtgttctggctgaagcagagatagccagggaccagacacttggttgaaggaaacggccccataactgcctggtgttcatgcccaccaggtggctctgtttggggtccggcccctcattaattctgatgttattcagctaagcacctactcctcacagccatgttaatccggactgctgctattttaggattctgctggaggaaggacgctgtgtatcgagaaaagataagggtgctaggtatcacagttagctggcctcttctaaggatcctgtgaaatacggaaaagcttctttggggcagactgattaatggagaaaaaggaacttttaatatgactaggttttaaaagatatcttagagttctatggtaatcggatgcgtattagagaagaagggaatctgtggcattttaggtaatcggaagaccgttccattgccacccgcagtacaacagtcggaatgtggctcttggaccattataggtgtgcctgacagaggcaaggttgctttgttcatcatcatgcttccggccagatagacagcagacgatgggagggtcctatgggccccatagtttatcctgcccattcttgtctccagtaaaaattgtgaagtgtgaggacaggactggactgtatcacctgctttttaccctaacaatgatcaatgtaccccaaacagtccttagtaacagcatagttcatcaaccccaaggtcttttgagccatcttgaaggtcttatatcctctctgtgctatcctgtctgtgctattccctggctgtgatgcattccagatgtttactgcaccgcctatcagaagcacttcctgttagatatctgcgtgttacctcctgaagaattcaggcactgggatttggtgaaaaggtccaagttccccgctgtgcatcggaccatactctgcttctgcaggtctaggctgaaaagcctcatccttgtggccaaatgttgcctttctctgagtgttctcttactgttttgcatctctcttgagttttagaagctgtagggtgattttgtagaaggttggggacaactggttgtttccagatttcaccttaatggtactctttgctgggttggctcattaaagccaaagttatgcacacgacagaggccttatatgcagccttttctctgtcatgttgctaatggcacaaagagcattaagcttgagtgagtcttggtggtttttcttttagcacattgccctgtacttgctttctttgaagcacacataccaccttcccaccactagacccatcagatctagaaagctagatctccgaaatctagcactgcatggggtgtgcttagctgtggctcagaaaaatgaaggatctccccaaggctacccagtttagggtggcagagctgggactaccccacctctgttgatgccaatataaaatgatgccgtgtcatttatagtttttatcctttgttttacttcagctgtcataaggagcaatctcataattatttcactttggtgtgcatccttgtcgaaggcatgttaaaaataaaagtaaatttttgagccgggcgtggtggcaggcatctgtaattccagctacttgggaggctgaagcaggagaatcgcttgaacttgggaggccgaggttgcagtgagctgagatcgcgccattgcgctccagcctgggcaacaagagcgaaactccatctcaaaaaaaaaaaaaaaaaaagaaaggccaggaactggctcacacttctgatcccagcactttgggaggccgaggcgggtggattgcctgaggtcaagagttggagaccagcttggctaacatggtgaaagaaaccctgtctctactaaaaatacaaaaattagctgggtgtggtggcacacgcctgtagtcccagatactctgaaggctgaggcaggcgaatcgcttgaacccaggaagtagaggagttgcagtgagcccaagatcacaccactgcactccagcctgggcaacagagcagagcaagactccatctcaaaaaaaaaaaaaaaagtaaattcttggtgcaggttcttctttgttcacatgtgtatttaccctttctaagaaattattcgggccaggccaggcatggaggctcacacctgtaatcccagtactttgggaggccaaggcggatggatcacctgaggtcaggagttcaagatcagcctggccaacatggtgaaaccccatctcaactaaaaatacaaaaattagccaggcctagtggctggtgcctcaactacccaggaggctgaggcaggagaatcgcttgaacctgggaggtgaggttgcagtgagcccagatcacactactgcactccagcctgggctacagagtgagactccatctcaaaaattaaaaagaaagaaattattcaggctccgttttgtcttttgcaaagcatgttttcttaacctttacattacatttgctcacatatttagagaccttaacctgtgtatagtttctacttgcttgcctgtggccatctcctaagagcagtttgtgcccattaataggagagttggcagtggtgcctcatgagctatcacagaagaatcagtaaggaatccggaagtccttgattgcatcttctctcccttttctttgtacctactggttttttggtacccagtgggccttcagacatgtagtatcctgtgtgactgtgctgatcctcagggcctaacagatatcctgacctgagagcctggagtattccacatctcaagagggagcagagctgtcaagcacagatgtggtgcatatagagtttttttttttttttttttaaatgagacagactcttgctctgtcacccaggctggagtgcagcggcgccatctcagctcactgcaacctccgcctcccgggttcaagcaattctcctgtctcagcctcacgagtagttggaattacaggtgctccaccatgcccagctaatttttgtacttttcgtagagatgaggtttcaccttgttgaccaggctgatctcaaactcctgacctcaggtgatccacccaccttggcttcctaaagtgctgagattacaggcatgagccaccgctcctggccacatgtagatacttccagagggagaacagaccctgccaggtctctgccggtgatgggagttgggcagccagcaggccctggagcagccttaccatttctcagcccctgcctgagtgccacattttgacattatgctaagcacaccccatgcctgcttttttcctcctaaacagcatctttatttggtaggtactgtttcagccccacttcaaaaggtcccagctcagggaagctaggtagtttgctcagctaatctgagtggacattgactccaaagtccatactcttactgcaacaccttagtgagctccgagtttatttcccatcaaagctgcctgaggcttatcactttcctattctagttgagttttatcataagcccagccaaagctgtgctttttgtcataacttcatcgcctcagtgttgaggctttagttggtgatcccagggcaaagccactctcccattgtcattcacaaagcttcagaggctttagccaatgaaagctggctccaaagaacccatcctgggctgggtgtggtggttcactcctgtaatctcagcactttgggaggctgaagcaggaggccagcaggatcacttgagtccaggagttcaaggctgcagtgaactatcgtcgtgcctctgcactccagcctgggtgacagagtgagacccttcctttaaaaaaaaaaaaaaaagacctcatcctgggttttctccactgcccctgcaagcggtgcctgcttctcacacagctctcaacctggccctgggtggagatagactcacacctctagaccccagaaagaggggccgcagatagtcatttcttctgagcctttctgcctctcaagtgtggccaccaaagggcactggcaacagccccaggaagcatctttggagaatgaggaagttggggagtagaagtcaggtgaatcacaattgacagcagccactggaagatcaagggccttccagggagagcctgtgtgcctgataggtggtgactggggcagctgacactgccaggccctgcggggcctgttggtgtctgtgggataacctggctgggcactagagggctctgttaagaggcctgtgtcgcaggcctgtctggaagctaaaaaggtcacagtgaggagacgctgagcaggttgcacagatgcataaagagggattggggcattggggaagtgtctctaattcagagggactccagcaagaagggaggcggggtgggacagaagtccttttaagcctttctgcctgcagactgtttgggtcaggagtggttagagcaatgggcagatagacaggaagaggcaggaccttcaaaacaaatctagcctggtgactcaccagtgaccttgagcaaagtcagttccatgggatcctattacagctgcctacttccctgatgactagagggcaccgccaagcagtgtttaccaaaatcaacaggccagagcacagctggaaggtaggaggtgttctgtgtctagccagggcatcgtggactgcaccactggcttgaatttcaagttagggtcctgcgttgcatgccatttctctctcgaataaaatcctacatacataaccttcaggggttttctttagcaatcccctcatgggagcaggtgcttgttgccttccctgctgtaccgacgtctaggaagggaggagagaaagacattgagatactgactccagaagagtctctgagctgggctccaagcctgtctaggataactgcctgttcttccggtgtgctctgagaccctctgaggaaaacccacttgttacatgggccaggcccctggggtatctgttaacgttacccaaagggaatttcatatttggttttctcactaaccctgagggtttactcacagctttggagtggggaaaggcagttatattgaaacaaaacctattggagttttaggtcaaaagtctcttctctctatcatattgtcatacttgtagggtaggcccttagtctggctttagtaggccttggtccacacgggctgacgtgtggtcaaggaagtcttggtagaagaaggaaaggcatgctgaggtgacacactggcccagctgaaacagcctctggttaataacagcacaggtggctgctctttcatgggcacggtgtcagctgacccagcatgccctggtggtgggtggggcagatgttattgttttcatttgatagatgagagaacagaggtccagcgcactcaagggacttgctcaaagtaacacagtctctgctagagctaggattcggcgccaggtcccaagcctttccggtgtcctgaccacttcctagagcaggctctgatggttgcaatgctgcaggagcttagacaccatgcctggcaggttttgcccaataattccccatgtgaggacttaatgacccaaaccttttttgcttcttagagagatttcattgcttcaagctgttcctctagtgagcttagcagctggctctgaggatggctccaacagtattcctgttagcttctgacccctcattcacgcacaactctttaggaattgattgattatctccagggaaaaatacagtggccgagtctggtacttagtgattccgagcagcacagtgtaggggagcctgatcatggtttggaatctagctctgcagcgtgtggcctggaggaagccacttcaccttctggagcccccgactcctcatctgagctgtgtggtaaatccccaggggggcacttcacccatctgtgtgcacaggctgttccaggaggggtatacaaggcccctccaacaatatttgcctttggagaggagcaggtggacatccgcaaggggagggatgtcctcttggaagctttttatcatgtgcatgtctccttactagtaaaattcatgtataatgaaacataagacaataggagtatatgtcatggatgtacatttttaaggataatcaaatgaacatccttgtgctcaccatccagccaaagaaacaatacaggctccttgaagcctgcacatattacttttcttactccaactgcctggcctcatcagtaatgtgagtggaatctgacacggcctactgcagagcggcatgtgacctctggtaggttattcttggaagcactataagaacactgccccatccctgccacatgccacgtggaccccaagaagaactctcttagcttttaataagatttaaaatacagccaggagatagcccctgtctcctagagcttttctttcagtgaggccccatgcactatggctctgcagggctgggttcaatgaaggctggtcccagttgctggcagggttcacacacaggcaggctttctggcagtagacagttacccaggctggatgcttgggcccaaaacagatggtcagcagacaagagatcatgacagatagttctgagggctgcttcgtgggtgacccaaagccagacagaggtgtatgagccttgtctgggcccagccagcctctgctgggcgaactctgagcctgaggcagggtatgcgtgctcaatcctagaggctcagggcttctctctacccagaacctgtgatgctggcatctgttgggctgagtcagctttgctgggtttaggtcccctccccaggttcctggactttcccccatcagtccaccttcctctgaggtctggaaccagtgtttcttgaagtgtggggcttggatcacctgcatggggattacctgggctgcttgttaaaatccagattcctaggccctgctccagacctagaactcggactctctggggacctgggaacacgctttcagccagtgccacagtgatttgggtatgccctagagattgatgatcacaccccacaccctctcagcctgagatcaagttcaggaaaggacgctatatagcctgagtcttgccagccctttccaaattttcctaaatcacttggtgacccatggcctaaataaaagaagaacttgccagtggctgtaacagaagaaggagaggaagttaaggcccatttcctacttttttttttgaggcggagtcactctgtcaccaaggctggagtgcagtgatgtgatcttggctcactgtaacctccacctcccaggttcaagcagttctcctgtctcagcctcctgagtagctgggactacaggtgcacgccaccatacctggctgattttttaaatttttagtagagacagggtttcaccatattggtcaggctggtctcaaactgctgacctcaggcgatccacccacctcggcctcccaaagtgctgggattacaggcgtgagccaccatgcccgaccccatttctactttttatgaaagcttaaaatacttaatcatggcctggtttctttttggttcagcctttattctaccctatgcttctgggagcttttgcagtttgcatagttatcaaaggagacagacagtatcatctagttttttgtttttttgttttgttttttgtttttgagatggagtctcgctctgtcgccaggctggagtgcagtgacacgatgtcggctcactgcaacctccgtctccagggttcaagcgattctcctgcctcagccccccgagtagctgggactacaggcgcgcgccaccacggccggctaatttttgtatttttagtagagacggggtttcaccatgttggccacgctgatgtcgaactcctgacctcaggtgatccacccgcctcggcctcccaaagtgccaggattataggcgtgagccactgtgcctggtagtgtcgtctagttgaaatgtttttttaaagaatggctaaagtactggagggaaatacaagttgctgtgtgtctgctgcgtggttgttgtcatgggctctccctgcaccatgacccccaggaaccccttgagtgctgtgtcttttctttcagcctcttccttttccttcatttatgcccttgacgtgtgcacgttggcactgtccaaggcttctggggcttttgtggtataaatgtggtggcttcctagcttttcctgttgatggcttgtccccagctctgccgagtctgctgagtcccttttaggtaggtctatttccctttactttccagtttttggaaccttgttttatacctccctttctttttgtgtgggttgccttttaaaagaattcttttgttctcgtagagttcagggagggagctaaactaaatgtgatatagtctaccaactttcctaatctatgtaatactttcttgtagctgcacatttctctaaactgccgcaacttccttcttcctcttttctttattttacttttttttaaaattgtggtaaaatatacataacataaaacttagcattttaactttttttttttttttttttgagacagagtttctctcttgttgcccatgctggagtgtgaaggcgcaatctcggctcaccgcaacctccatctcccaggttcaagcaattctcctgcctcagcctcccaagtagctgggatcacaggcatgcaccaccacgcccggctaattttgtatttttagtagagacagggtttccccatgttggtcaggcttgtctcaaactcctgacctcaggtgttttgcccgccttggcctcccaaagtgtgggattacaggtgtgagccaccgtgccctgccaacatttttttttttttttttgagacagagtctcactctgtcaccaggctggagtgcaggggtgcaatctcggctcactgcaacctccaccttccgggttcaagcaattcttctgcctcagcctccagagtagctgggactacaggcgcatgcgatcacacccagctaatttttgtatttttggtagagacggggtttcaccatgttggccaagatggtctcgatcttctgacctcgtgatctgcccgcctcggcctcccaaagagctgggattacaggcgtgagctaccatgcctggccaatattttgtttttttaagagacagggtctctctcggtcatccaggctggagtgcagtggtgtgattatagcttacagtaactcctgggcgcaagcagtcctcttgcctcagcctcctaaggagctaagactataggcatgcgccaccatgcccagctaattttttttttttcctcaaagagacggggtctcactatgttgcccaggctgatctcagactcttggcctcgagcaatcctcctgcctcagccacccaaagtattaataaccattttaagtgttgagttcattgatattaagcacatgcatcatgactatctgtttccaaaactatcatcatttcaaactgaacctttgtgcacattaaatgataacttcctgttctcccctctccctacctgctggcaaccaccattatattttctgtctctataaactgattattctaggtatctcatatgagtggaattataaaatatttgtcctacatttggttgatttcacttagcatagtatcttcaagttcaacttctttttggaacaaaaagggaatgaatgagtgagtaaatggagaatcagcattaattgacctgtatggtcttagcctctctggctgtctcagctccaaagtcaggcttttcctgccagctcaaaatatcctttagcagaatgcattaacatgtcaggttaactgtcagtgtctttaaaaatggttagaagggcatggcatacacagtgaagtagaatcctgcacttaggctagtcctgttggaaagagaaggacttgaggtacaggagagcagtggcctctgctaatgtggaatttgctccagctaccctgcagaccacccaggagcaggggctaagacagcgtcctccagaactgccctggctcccaggactgtggtggaggggaatcaaactccttctaggtggggacttcctgcaccaagtgttacttggggccgtgaaaatttggttctccctctacagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacgggtaagccgtgagcctgctcacagtgggagaggaactgctacagggtgggggcatcctgtctgagttgccggtgggggctctggtttctctgagcaggcacccttccaggagctcatgtgccaagctccagtctttcccagagtgtcagggtgtcagcagcctgctccagtctagctgctaacttgccaggatcacaaacccactcagcccagctgtagaggggaaatgttgctagaaattccacaaggaagctcacagctctctaaaatggcatttgaagctcagacctgacatgagtgaagaaggaaccaggcagtctcccgtgtctcccctggagctcctggtcagattctctcctctgcaccttcctgcttccctacagaaccggcttttcttgtatgtagctgctgtcctccctcgtgcctgcactgctgtgctggtttgaattgtggtgtgcctactccagctcccaagctgcatgaccctatttgctccttaagacagatggaatctgactggcctagatcaggtcagactgctgtccccaacctcaggccaggaatcccatggtcaagagagctcctccttgcagagtctggggccaggcaggttctctgagaatggggtttgggtagagaggctgtgattgggtcctcaagcatcctagctgtggagtgctcactaattccccttctgtgctgtccctctgtctcctagttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcagcaaagaaagctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaaggcactaacagcagaaggagcccaggaaggattttcagaagggaagggagggatgcaaccttattttaatgactggtgacagtaggaagggttctgcctggccttaagtgagggtgttgaaagtgggagacaggacctgccaaaggggaagagggcggtcacagtcaatcccagggcccagtgtctcagccaggtgctggagttgggaatgcgggagccccagtctctgcccacctgtcacgtggcagctggaaggtggcatcaactgcacaggcgaagaggggcccgcacacgagaagccatgggatgtgaagggccgcaaggagaggaccctgggacacaggaagaggtggtgcatctggggcagggcggctttcccaagatgactagagaatcttcagctggcatcttgcctgaaatatccacgctctcagccactacactaatggaacacagatgctatggggagacagaagggaactgacaaacttcatgcccctgttttcaaatagcctgcaatcttacctcttcctctgcattttttggggggagtgacattttaatgggaggcaggaggtttgtggagaagagaaaatgttttttttgtgggggtgggtagagacagtctcaccatgttgcccaggctggtctcaaactactggcttcaggcaatccttctgcctcccttcccaaagggttgggattacaggcttgagccactgcaccaagcctgaaaatgtcgttttgaatgagcccacctgaaacgaagacgcttcattagggttactggtttgagaattaagatcagttctggccgggtgcggtggctcacgcctattatcccagcactttgggaggccgaggtgggtggatcacaaggtcaggagatcgagaccattctggccaacatggtgaaaccccgtctctactaaaaatacaaaaattaaccaggcatggtggcaggtgcctgtagtcccagctactcgggaggctgaggcaggagaatcacttgaacccgggaggcagaggttgcagtgagccgagatcatgccactggactccagcctgacagagtgagactccatctcaaacacacacacacacacacacacacaccacacacacacacacaggttcctcaccataagctttggggaaaattcttggcttttttgctgggggagagagcagtgcccagggaagattggctgatctcagagctggagggtttatgcgggactggccagccccttcagctgagtgggacagcaacacagtgggtggtaaggggcttcataagatgtacaagatgagggagaggcccctccagccaaccctgtgtctaaagagtcaggtaacgaagaactttccagagacagctgtgagtccgtctggcttaaggggttgtacaggtgtctgagaatggggcctgaaggtgcagggcctgcaggctgccctgtttggaaggttcctgtccttctgtcttggtagaaaatggcagctagccttgtaaagggcctccttgtgtagcgagatagaccatgtagccccagatgcccccatggcttcacttccctcttgggggtctctcagtatatgtctagtgccaccactattggtggagagtttccttctggaataaccttggggtggtggatgggttttattttaataaaagaagaatgtctcattcattttttcttatttattttttgagacggagtctcactttgttgctcaggctggagtgcagtggcaagatctcggctcactgcaacctccacctccccgattcaaacaattctccaacctcagcctcccaagtagttaggattacaggcatgcaccaccatgcctagctaatttttatatttttagtagagatggggttttgccatgttggccaggctggtctcaaactcctgacctcaggtgatccgcccgtcttggcctcccaaagtgctggggttacaggggtgagccactgcgccctgcccccgttattgattctttccatctgtttgcttcctcatattctaacggggtatgggaaatttgcttgcatgtacacacatgcaatttctttcctttttttctctttttctttctctttctctttctttcctttctttccctcccttccttccttttcttttcttttttctttcttttctttgacaggatcttgctctgtctggaggctggagtgtagtgctgcaatcatggctcactgcagcctcaacctcccaggctcaagtgatcctcccaccttagccacctgagtggctgggactgcaggtgtgagccactacctctggctaatttattttttgcagagacagagccttgccatgttgcccaggctggtacacacccaatttctattatgtgtacaggcctgtgtctttcttcttgtttaccttatcagtccattaggccaggagtcgtgttgttgtttttatttttttttaaggtggagtctcactctgttgcgagtggacaagagtgcgctctggagtgctggagtgcagtggtgcgatcttggctcactgcaatctccacctctgggttcaagcaattcccctgcctcagcctcctgagtagctggaattacaggcgcacaccaccatgcctggctaatttttgtattttttagtagagaatggggtttcaccatgtttgccaagctggtcttgaactcctgacctcaggtgatccgcctgccttggcctcccaaaaagctgggattacaggcatgagccaccacacccggctgggtcacgctttttaatgtgacattcattcagcaaatacactgaacacaagtgccttgtggaggatgcagaaattctaacacatatgatccttgccctctaaggccttccaatccagccaccaggaaagaggaaacctgatgacaccgaaacgtgatagccaaggaacacttcctaaagaagagacttgatctgggccttggagaaggggcaggccttcatgagagcatggtgtaggcagtggtgtgaaagcaggaaaggaagggcgtggctttggggaacactgagttgatgtgagcagctccttcccactggaggtgcagggcaagcaattagctcatggacctagcccaggagggcctggaacatcaaggttgtcagaatgctcacagctgcaagacccagaactgaaaatttcttaactaaatggaatttattgttttccacaattgaaaagttcagcgtagtcggggggactgggctgggtccagggactcaaacaatgacacaaagacacagtttctctccacctctttgctttgtgtgtctgctcaggccatctctccccaaaggtggtgaagatggccaccagcagactggggctcaccctagactcctttttaaggtaacaggatgactctcttttgcccaacttagatcatgccccttaccctgaaccctggcaaagaacgtggagcttcctcctgtggtccaggtagaggatggttacatgtggggtctgggattcagaggtggcaccgctggcagtggttgggacatgtgagcacaagggtgaggcctacaccactctgaggccttggctgccccttctctctcccccagccctcgcctttccatgatggtaagacatgaggccactcaccagctctgccttcttgaagaaaatcagtgtcctatctttgaacagagctgggccttgaagtcaggctcacccactctcaaaccgtgggggaaacagagccttggttacaccagctctgtctcagggattgttttttctgcttctctcctacccttgcccgtttcttcctgctcctttccagcaccctcccagctcctcactttcctgacttttgttttcttttccaagcagcttgagcagtgcttgatgctcctgggtcacagcgtgcacacatcctggctgttctgggtaaccgcacacccaaccccagtcccatccccatatctctatcctgaaatcaacccaaagggtggggagggagcaggcaacagcagacaacagaaggcgggggtactgagagcatgtgctgctattcaggtaccctttgcagtaattccccagaagcactaacatttctgctgatcttggaatgatgctgtattactcagggttctccagagaagcagaacaataagatgtggagatatatgtatatatacagaaagacattataaggaattggctcatacaaatgtagaggctgacaagtcccaagttctgcagggtgagtcagcaagccgagacccaggagagccgaggttgtagttctagtctgaaggccagcaggctgaagatccaggaagagctgatgtttcagttcaagtccaaaaacaggaagaaagctgatgtcaccacttgaaagttggtcatgcaggaggggcgccctccaactcagccttttgttctatttgggccctcagctgatggatgaggatcccctgcgttagggaggcagcctgctttacttgctccaccaacataaatgccagtcctaccccacgccctcacagatggacccagagtaatgttcaagctgatatctgggcaccccatggtccagtccaactgacacataaaattaatcatcacagatgccttcttcagcacatgctcgatatctaacaaatatctctacggtgagattttccccccaaccttgggcccacttaagaaagatgttgaactgggcgcgagggctcacgcctgtaattccagcactttgggaagctgaggtgggtggatcacttgaggtcaggagtttgagaccagcctggccaacaaggtgaaaccccgtctccattaaaaatacaaaaattagccgggcgtggtggtgggcgcctgtaatcccagctacttgagaggctgaggcaggagaattacttgaacctgggaggcagaggttgcagtgagccaagatcatgccactgcactccagtctaggtgacggagcaagcctccgtctccaaaaaaaaaaaaaaaaaaaaaaaaaaaagaaa

SEQ ID NO: 14107 - DNA, 5947 bp, Homo sapiens
ggccacaaacaactgcttgtgatttttttttatccttactgaagaaccaatttgcatccctgttgagaatacagggcttgtggccagtaataactctcccttttaggattcctgtctttccccattttttttctatccccagttgccatcacagcgtaacggtgcagggaggtatatgagggttgctaagggaaagcagaggtgcccctcactcaaacctacattcagaaaaaaatttccttcattattgattggatgtcttaaatgcaaagacttacacagaaactgggaagggaggacctatttcagacaaggattcaccatggaatttttatgaatatccttataaaataggacttgggatgcagatggattatttctttaagtcttgcaacttcagaaaagcctgagacacataccccctcctactatatatagtgattataaatagtatatttacctccaaaaaatttaacactgtgccctaatgcaagaaaaatctgtggtataacaatgtactcatgttctgtagctctttactgaaggcctcatgtcaaaggcggggaaggaaagcaattctgtggctctgcacttctacccaagtctgaagagaagtgagccaagttaaatgaaggtcaaggatgctcctcctggtcctctcaggggctggtaaagtcttatatgacgttttctggggagtcattactctgtccaaagtcgaggtagctcagaggccttcaggccgctgatacttccagaaggccacctccccatcatcactgcaggaggccagtagccctggctccttggggttccaggccacacagttgacatcctgggaatgggcctgatgcaagtgggctgtcagggagaaggtgggctgctgtggatccgagttgggatcctcctgaaacacgcggatcgcgtcatccccacaagctgtggccagagcccctgtcagctgacacctggaaggaaagtgacatcagtgggtatacctgactaattaggccagagagacctgttccatagttcctggcctgttctcttccctaacttcaggcctcagctaaaaacctcttattaaaatgtttccttaactaataaggagtcacaaatatcacccacttatatcttcagatgctgcaatctagttctttcccctactatgattatcctaaaaaacgacatgcaattatgaactgcactttcctcacttggcataagcagtttcccatgtcataaagttgtttttttttttttttttttgagatggagtcttgctgtgtcgcccaggctggagtgcagtggcacaatcttggctgactgcaacctccccctcccaggttcaagcgattctcctgcctcagcctcctgagtagctgggactacaggcatgtgccaccatgcccggctaatttttgtattttcagtagagacagggttttatcacattggacaggctggtctcaaactccagacctcaagtgatccacctgcctcagcctcccaaagtgctgggattacaggccatgagccactgggcccagccatcataaagttttttttttttttctttagatggagtcttgctccatcaccaggctggagtgcagtggcgcaatctcggctcactgcaacctccgcctcccgggttcaagcgattctcctgcctcagcctctgagtagctgggattgggtgcgtgccaacacgcccagctaatttttgtatttttagtagagacggggtttcaccatgttggtcaggctggtcttgaactcctgacctcatgattcactcaccttggcctcccaaagtgttgggattacaggcgtgagccacagcgcctggccccatcataaagtattcttaacccctttctttaaacagtgatacaacaagctgagttctaccataatttacttaagttcacttttgttgaataggtgattcccaaatgtttgctaatataaagcaagcttaagtgctcagtttttttcactgttttggatttcctagggatcaattctcagggccagaactaccctctaacctactctcctatatgaatggtgcagcttttccagcttccacaaggccagagtcagtgttacctataaaaaccccagccactgccaggtgcggtggctcatgcctgtaatcccagcactttgggaggccaaggtgggcggatcatgaggtcaggagatcgagaccatcctggctaacgcggtgaaaccccgtctctactaaaaataaaaaattagccaggcatggtggcgggcgcctgtaatcccagctacttgggaggctgaggcaggagaatggtgtgaacccgggagacggagcttgcagtgagatgagatcacgccaccgcactccagcctgggctgcagagtgagactctgtctcaaaaaacaaaaaaacaaaaaaaaaccctcagccacgaatgcagattcaataataacttctggacagcacgagctgtgcgaacctctagcgctggtgctaccctcacagcctgggactgttctctgctcctgtgaatgccagcccagccagctgtaaaccagcatggtagagtcaggcctgataaggaatgggggtggctgccctcaattcccaagcactcccccagggttgcagaggactgcatagggtatgccttctctaaaatccctgatttatggggatgggatggggtggggggatggagtcttaccaagcaatgtcataaatggtccttgagtggaagccggacaaagtacagatacatttccaactggggtcagagccgctgcatgccacccctgcaagacagacttctcttgcccttaaacgttcctatgtcctgggcacctcaaaggagaacctaacttaccttccctcaccctcatcttcaactgattatgagtctgtgtctccgttcgtgtccccatccctgcttatctgccttacacactatagccagactggcgtttctcaagcagaattccgaggaaacatccctgttctgttgcagactgtatgtaactactttgcgtgcctgtgaaggccacccaccagccgacccaacccactttattcctctccaaaccccagacgtcctatgccccatttaaatgcattaccacccctcagtctaagcattcccgccattgttatctttactcacactgttgagttttcacttgaattctcacgtgaaattctcatgttaaaatcctacatacccttttaaattcagatgaaacaacccattctacaaaactttcctgattcttccagcactctatccagagccctcttgtagcacatcttaccttttacccccatttgctctgactcatgtacgtgtcttagcagactgtgaaccccttgagagatgggtcttctttagctctactaatggacctcaccttgttcattgcctggtagatactgacgccagatacgcacagtacggtcatcactacaagacgccaggcgctggccactcgggtcaaaggccaagctccacacagtggattcatggccctcaagggtggcacagcatacccagtcatcctcttcctcccggtacagcttcactgtgtcatcatagctggcagaagctaagagctgggggaagagtgaaaggaaacccaacatgtgtctgtgtggcccaggaagcaaaggacaggtcagttccaggtatctgcttttattttattttattatttatttgagatgaagtttgctgttgttgcccaggctggagtgcaatagcacgatctcggctcaccgtaacccccgtctcctgggttcaagtgattctcctgcctcagcctcccgaatagctgggattacaggcatgtgccaccatgcccgctaattttgtatttttagtagagacggagtttcaccatgttggccaggctggtctcgaactcctgacctcagatgatccacccaccatggcctcccaaagtgctgagattataggtgtgagccaccacacccagccggatctgtttttataaagggactaatgttttttgttcacagatggaactctccgtaaaagctagattaaggctgaaaagcagaggaaggctgggcacaagcctgcacaccagagcccttcccacaagagtccctgcttgactcttacctcctgacttgggtgccaaaccacatgcttgacatcctgtgtgtgggagttgagaacactgacacattcatactcatcctcttcatcaactgtgggagagaaaaaggggacccaagagccgaccctgtcagggacacagagggggctgtcaggtggttcccaatccacctggagggacctggcctcaccttcccagacccaaacgctcttatctcggctgcaagtggccaggaggttgccagatggggcccaagccactgacttgacctcattttcatggccctcgagagtggttacacactgtgaaaggggaaagaaaatgagaattaacagcagctaacacccctaagccccttcccatgggtacagcccaactggcgcaggttggctcaggttcctgaaccagccctggggaggaaacaggcaataattctggtcccaaccagcctgggtacctcaaagtcatcctggttcttcttccaaatgcaagtggtagcatcaaagctggcagaggccaggtaattaccgcagggggaccaggctaccttccgcacggtgcgctggtggccttcagaaaggacagacttgcagatccagctgtcacctaaaggcggagcgcaggccaggctctggagctgggtgcagcaccatgaagccattcaatatcaggggctagcactggaatcaagctagtgggggaaagctcagggagtgtatttcacagcttttacaaagatgcaaatgaatctacttcgtctggaagcttttttttttttttttttttttttttgagacggagtttttgctctgatgcccaggctggggtgcaatggcacaatctcggctcactgcaatcttcgcctcctgggttcaagggattctcctgcctcagcctcccgagtagctgggattacaggtgcccgccacaacgcccagctaattttgtagttttagtagagacggggtttcaccatgttggccaggctggtcttgacctcttgacctcaggtgatctacccgcctctgcttcccaaactgctaggattacaggcgtgagccaccgcgcccaacctctggaggcatctttctaaaacaaatctgatctaaaattgctattggttccccaatgccctcgggataaaatgtgaccatccagtcgcaagttactctgaaggccactttcctaacacctctcttttcccattttcctgcctctgcagctaacacaattcccttgacatttcagcttgtctgctgacgtttttcctcccaacagtcgcagacttctttgcctgtaaagcccttctcggcgtggctaacatcccactctccctccgccaggaacaggttcagcctcccctgcaggctgagcgcctgcactacgcgcaggctgagccctcagcgctgagggccgcgcaaccaggctgggccttaccctccgtgccccagatgcggattctccggtcgccgccgcacgaggccagcagggtccccgcggggttccaggccaggaaccagcagcgggagtccgggtgcgccgggacacggcccagcagcaccagcgagtccttcatgtcggcccgacgcagggggaggtgggggcgggcagagtccgctgagcagacagcgggtctcaccgcgcgcgtctgcgtaccgcccactccaggcttccgcggccgacagaggctcccgcttccgccggaggacctgggtcgccccggaaactcaactgcccactgctgcggccgccataccctctgggagttgtagtcgctcccctcacctcggcaggg

SEQ ID NO: 14108 - DNA, 2000 bp, Homo sapiens
tgcagagggggtgtgcagagctccagcaccgtgcaggtggagagagtccgtgctctaactcccaacactggttatccgcaccaggatactctgttgagttccatgacagaatctgtttcagggcgggctccctggaggctgactttgagatggagattcccatgcagggagtgtactggggctgctctcaggttcagcacctacagaagggaaggaagcagacttgctcacagggagaagctgggctgcaaggcagtctcgacacacccctcagctgaacccatggaaggtgttgaagcattagaaaagtctcatggccgtcccagcttcagatgcccccagcccccactgagctgaggggccagacctttgtaccccagcttcagccagtcactgggtacacactgtccccagaggggtggtgggacattgggtggggaagctgtcttcacttgggggcaattcctgaggagggctgtgagccagcaatcctcccagcagctggggcagagcctgtcttgagggggatttggattgtttatcagggcgtccacagcctcttgtgccactcagatccactcctctgggtaagttctgggagcagctcgtctttctctggaacaaactaatggttcatcagatgaccacagcccccaccactgcagctgttcttgaggtctcaccgatactccccatctccctcttctatccattttatctttatttatttatttagagacttgttctgttgcccaggctggagtgcagtggtgtgatcacagctcactgcagcctccacttcccaagctcaagtgatcctcctgcttcagccacctgagtagctggaactacaggtgtgtgccactacacccaactaattaattttttttaagagatgaggtctcactatgttgcccaggctgatgttgaatttctgagcttgagtgatcctcctgcctcaggctcccaaagtgctaggattacaggtatgaagcactgcacctggacttctatccattttattttattttactttttttttgcgactgagtctcactgtgtcgcccaggctggaatgcaatggcacgatctcggctcactgcaacctccgcctcccaggttcaagcagttctcctgcctcagcctcctgagtagctgggattacagccacatgccaccacacctggctaatttttgtaatttttttttagtagagacagggtgtcactatgttagccaggctggtctcaaactgtgacctcaggtgatcctcccaccttggcctcccaaagtgctgagattataggcgtgagccactgagcccgcctcggcttctatccattttagattctcctccctgcaggaagcacctcagctgagcccctggccaccacacccttttcaggctatggctgctgcacctgtgcatttatcatcagcaaggggcaagagtacaaagacatattccttctggctcccactgtgcaactgcagccccatctcttcctggtgggcagggtccactactcctgccaggatggtggctcctgcttcttgcctactggttccttggtgtacttttgctgtatcccttcatggaaacatttccttattgggaaccagaacctaaaaccctcaaagcttagagttgtggtaacagaaataccccaatgggattaatgtaaagtgaagccgctcctatctctaccccttggttcctggacctatatattcctcccagtgggacatagcgccttattggttgttgattagagtgtacactgtgccctggaaggtagtaacccctccttacttggtatcatcgtctctgagctggcatctcagctacgccttcaacagcccatttcttctcttcgttcaagccagtatcttctgggtggtgcagaatgtgacaggaccagtgatcccatggtcacgtgccattgtcatgcctccttcgccttgcaatgaacgggcccttgggtctgatgtgatgttac

SEQ ID NO: 14109 - DNA, 8047 bp, Homo sapiens
tttttgtttttttttttttctttttaaataacaaatttatttttcacagttctggaggttgccccaaaaagcttttattatctagattaaggttaatgcacttttaaatcataatgttaacattttttttcttaatagagacagagtttagccatgttgcccaggctgaccttgaattcctgagctcaagtgatccgcccacctcagcctcccagagtgctgggattacaggcatgagccaccatgcccagcccacgttaacattttttatgaagaataacttccaaaacaatccaaggagaagggtggcattttacagtctctttagtatcttgttataataaacagttgaattcttacagctgcttctacatccaaacttttttgttgaagtaagttgacttcacacagatacgcagttggaaaagtttttaaaatagccttttcagctaattgtggctattctttgataccacaccaagactacaagtgattttttttttttttttttttttttgaaatggagtctcgctctgtcacccaggctggagtccagtggcacgatctcgactcactgcaacctccacctcccgggttcaagctattctcctgcctcagcctcccgagtagctgggactacaagggatctgccaccacgcccggctaatttttgtaattttagtagagacggactttcaccatattggccaggctggtcttgaactcctgaccttgtgatccacccaccttggcctcccaaagtgttgggattacaggcgtgagccaccgcgcccggcttactacaagtcatagtttcttaaaggcaatgtagactccgaaaacttaatgcactcttatattgttaatacattaaaatccactggcctgtcttacacttttgaatcaatctttgagccatgcatgattttgtaacatcacgtactggtcacttggaaaaatggttcattgaattcttccaaatgaaatgcatttcattatacaaatcacatttgttaatatccccaacaataaagctcatggtggagtacagattttcggaaattccaatttttgcttgaaagctttatcactggcaacactatcagttgtttcccttgaggtgagaggctcattccattaatttccagaaaatatcagccaaatattcaagtctaaataccgtaatctgctagttctttcaattctaaagggcatgccttgaacacagccaattcagcttgcaactcaactgtgtaactgcttttcctcaaggcacccatacttcagtgcacagcagaggggctttatgcatgcttccagttttctcagaatattataaattctcaaggtcaactttttttttctttttgagacagggtttcactcttgttgcctgggctggagtgcaatggtatgatctcggctcactgcaacctccacctaccggattcaagcgattctcttgcctcagcctcccgagtagctggaattacaggcatgcaccaccatgcccagctaattttgtatttttagaagagacggggtttctccatgttggtcaggctggcctcgaactcccgacctcaggtgatccgcccgcctcagcctcccaaagtgctgggattacaggcatgagccactgcgctggctaggtcaacatttaatagttaaccattgctatttgttctatcaaggacatatcacaactactagaagtgtgctgccacaccttgattcatgccacagtgccaacagttgacctcacagatcctccctgaaagggtcttgggactcccaggatctgcaggccgcattcttcgagaaccactattctaggtacagccccactgtccttctaaaatctaaggtcacagcttaaacttcagggaaggctgtagttttggaggccattgtcacattagaacccatttagaagtgactgtcaagagacaacttgagtgagtctgaaactgcctgctgatggcagtgtttctcaactggtttaaatcgccagtcccctaggaagccttcttcctgatcactccctgccatgaaaatggaatatcacagacacactatatgtgctgtgggccttaggagggccacaaacaactgcttgtgatttttttttatccttactgaagaaccaatttgcatccctgttgagaatacagggcttgtggccagtaataactctcccttttaggattcctgtctttccccattttttttctatccccagttgccatcacagcgtaacggtgcagggaggtatatgagggttgctaagggaaagcagaggtgcccctcactcaaacctacattcagaaaaaaatttccttcattattgattggatgtcttaaatgcaaagacttacacagaaactgggaagggaggacctatttcagacaaggattcaccatggaatttttatgaatatccttataaaataggacttgggatgcagatggattatttctttaagtcttgcaacttcagaaaagcctgagacacataccccctcctactatatatagtgattataaatagtatatttacctccaaaaaatttaacactgtgccctaatgcaagaaaaatctgtggtataacaatgtactcatgttctgtagctctttactgaaggcctcatgtcaaaggcggggaaggaaagcaattctgtggctctgcacttctacccaagtctgaagagaagtgagccaagttaaatgaaggtcaaggatgctcctcctggtcctctcaggggctggtaaagtcttatatgacgttttctggggagtcattactctgtccaaagtcgaggtagctcagaggccttcaggccgctgatacttccagaaggccacctccccatcatcactgcaggaggccagtagccctggctccttggggttccaggccacacagttgacatcctgggaatgggcctgatgcaagtgggctgtcagggagaaggtgggctgctgtggatccgagttgggatcctcctgaaacacgcggatcgcgtcatccccacaagctgtggccagagcccctgtcagctgacacctggaaggaaagtgacatcagtgggtatacctgactaattaggccagagagacctgttccatagttcctggcctgttctcttccctaacttcaggcctcagctaaaaacctcttattaaaatgtttccttaactaataaggagtcacaaatatcacccacttatatcttcagatgctgcaatctagttctttcccctactatgattatcctaaaaaacgacatgcaattatgaactgcactttcctcacttggcataagcagtttcccatgtcataaagttgtttttttttttttttttttgagatggagtcttgctgtgtcgcccaggctggagtgcagtggcacaatcttggctgactgcaacctccccctcccaggttcaagcgattctcctgcctcagcctcctgagtagctgggactacaggcatgtgccaccatgcccggctaatttttgtattttcagtagagacagggttttatcacattggacaggctggtctcaaactccagacctcaagtgatccacctgcctcagcctcccaaagtgctgggattacaggccatgagccactgggcccagccatcataaagttttttttttttttctttagatggagtcttgctccatcaccaggctggagtgcagtggcgcaatctcggctcactgcaacctccgcctcccgggttcaagcgattctcctgcctcagcctctgagtagctgggattgggtgcgtgccaacacgcccagctaatttttgtatttttagtagagacggggtttcaccatgttggtcaggctggtcttgaactcctgacctcatgattcactcaccttggcctcccaaagtgttgggattacaggcgtgagccacagcgcctggccccatcataaagtattcttaacccctttctttaaacagtgatacaacaagctgagttctaccataatttacttaagttcacttttgttgaataggtgattcccaaatgtttgctaatataaagcaagcttaagtgctcagtttttttcactgttttggatttcctagggatcaattctcagggccagaactaccctctaacctactctcctatatgaatggtgcagcttttccagcttccacaaggccagagtcagtgttacctataaaaaccccagccactgccaggtgcggtggctcatgcctgtaatcccagcactttgggaggccaaggtgggcggatcatgaggtcaggagatcgagaccatcctggctaacgcggtgaaaccccgtctctactaaaaataaaaaattagccaggcatggtggcgggcgcctgtaatcccagctacttgggaggctgaggcaggagaatggtgtgaacccgggagacggagcttgcagtgagatgagatcacgccaccgcactccagcctgggctgcagagtgagactctgtctcaaaaaacaaaaaaacaaaaaaaaaccctcagccacgaatgcagattcaataataacttctggacagcacgagctgtgcgaacctctagcgctggtgctaccctcacagcctgggactgttctctgctcctgtgaatgccagcccagccagctgtaaaccagcatggtagagtcaggcctgataaggaatgggggtggctgccctcaattcccaagcactcccccagggttgcagaggactgcatagggtatgccttctctaaaatccctgatttatggggatgggatggggtggggggatggagtcttaccaagcaatgtcataaatggtccttgagtggaagccggacaaagtacagatacatttccaactggggtcagagccgctgcatgccacccctgcaagacagacttctcttgcccttaaacgttcctatgtcctgggcacctcaaaggagaacctaacttaccttccctcaccctcatcttcaactgattatgagtctgtgtctccgttcgtgtccccatccctgcttatctgccttacacactatagccagactggcgtttctcaagcagaattccgaggaaacatccctgttctgttgcagactgtatgtaactactttgcgtgcctgtgaaggccacccaccagccgacccaacccactttattcctctccaaaccccagacgtcctatgccccatttaaatgcattaccacccctcagtctaagcattcccgccattgttatctttactcacactgttgagttttcacttgaattctcacgtgaaattctcatgttaaaatcctacatacccttttaaattcagatgaaacaacccattctacaaaactttcctgattcttccagcactctatccagagccctcttgtagcacatcttaccttttacccccatttgctctgactcatgtacgtgtcttagcagactgtgaaccccttgagagatgggtcttctttagctctactaatggacctcaccttgttcattgcctggtagatactgacgccagatacgcacagtacggtcatcactacaagacgccaggcgctggccactcgggtcaaaggccaagctccacacagtggattcatggccctcaagggtggcacagcatacccagtcatcctcttcctcccggtacagcttcactgtgtcatcatagctggcagaagctaagagctgggggaagagtgaaaggaaacccaacatgtgtctgtgtggcccaggaagcaaaggacaggtcagttccaggtatctgcttttattttattttattatttatttgagatgaagtttgctgttgttgcccaggctggagtgcaatagcacgatctcggctcaccgtaacccccgtctcctgggttcaagtgattctcctgcctcagcctcccgaatagctgggattacaggcatgtgccaccatgcccgctaattttgtatttttagtagagacggagtttcaccatgttggccaggctggtctcgaactcctgacctcagatgatccacccaccatggcctcccaaagtgctgagattataggtgtgagccaccacacccagccggatctgtttttataaagggactaatgttttttgttcacagatggaactctccgtaaaagctagattaaggctgaaaagcagaggaaggctgggcacaagcctgcacaccagagcccttcccacaagagtccctgcttgactcttacctcctgacttgggtgccaaaccacatgcttgacatcctgtgtgtgggagttgagaacactgacacattcatactcatcctcttcatcaactgtgggagagaaaaaggggacccaagagccgaccctgtcagggacacagagggggctgtcaggtggttcccaatccacctggagggacctggcctcaccttcccagacccaaacgctcttatctcggctgcaagtggccaggaggttgccagatggggcccaagccactgacttgacctcattttcatggccctcgagagtggttacacactgtgaaaggggaaagaaaatgagaattaacagcagctaacacccctaagccccttcccatgggtacagcccaactggcgcaggttggctcaggttcctgaaccagccctggggaggaaacaggcaataattctggtcccaaccagcctgggtacctcaaagtcatcctggttcttcttccaaatgcaagtggtagcatcaaagctggcagaggccaggtaattaccgcagggggaccaggctaccttccgcacggtgcgctggtggccttcagaaaggacagacttgcagatccagctgtcacctaaaggcggagcgcaggccaggctctggagctgggtgcagcaccatgaagccattcaatatcaggggctagcactggaatcaagctagtgggggaaagctcagggagtgtatttcacagcttttacaaagatgcaaatgaatctacttcgtctggaagcttttttttttttttttttttttttttgagacggagtttttgctctgatgcccaggctggggtgcaatggcacaatctcggctcactgcaatcttcgcctcctgggttcaagggattctcctgcctcagcctcccgagtagctgggattacaggtgcccgccacaacgcccagctaattttgtagttttagtagagacggggtttcaccatgttggccaggctggtcttgacctcttgacctcaggtgatctacccgcctctgcttcccaaactgctaggattacaggcgtgagccaccgcgcccaacctctggaggcatctttctaaaacaaatctgatctaaaattgctattggttccccaatgccctcgggataaaatgtgaccatccagtcgcaagttactctgaaggccactttcctaacacctctcttttcccattttcctgcctctgcagctaacacaattcccttgacatttcagcttgtctgctgacgtttttcctcccaacagtcgcagacttctttgcctgtaaagcccttctcggcgtggctaacatcccactctccctccgccaggaacaggttcagcctcccctgcaggctgagcgcctgcactacgcgcaggctgagccctcagcgctgagggccgcgcaaccaggctgggccttaccctccgtgccccagatgcggattctccggtcgccgccgcacgaggccagcagggtccccgcggggttccaggccaggaaccagcagcgggagtccgggtgcgccgggacacggcccagcagcaccagcgagtccttcatgtcggcccgacgcagggggaggtgggggcgggcagagtccgctgagcagacagcgggtctcaccgcgcgcgtctgcgtaccgcccactccaggcttccgcggccgacagaggctcccgcttccgccggaggacctgggtcgccccggaaactcaactgcccactgctgcggccgccataccctctgggagttgtagtcgctcccctcacctcggcaggg

SEQ ID NO: 14110 - DNA, 8098 bp, Homo sapiens; identical to SEQ ID NO: 10119

SEQ ID NO: 14111 - DNA, 6462 bp, Homo sapiens; identical to SEQ ID NO: 10120
  misc_feature (328)..(328): n equals a,t,g, or c

SEQ ID NO: 14112 - DNA, 327 bp, Homo sapiens; identical to SEQ ID NO: 10121

SEQ ID NO: 14113 - DNA, 3387 bp, Homo sapiens; identical to SEQ ID NO: 10122

SEQ ID NO: 14114 - DNA, 2907 bp, Homo sapiens; identical to SEQ ID NO: 10123

SEQ ID NO: 14115 - DNA, 1678 bp, Homo sapiens
gtagttctctggacttttccccagaatagaagaaaagagataaatgggatctgtgcacagatatttactgcctcaggcctgtgagggaatgccaagttgtttgttgacacaattttggtagtctcgatcagaatcagcaaactgtgactcatagaccaagccctgcctgtcctgtttttttgcatggccctgaacagaagaatgagttttacattttttgatggtttaatggtgatgtgtgaaaataatgtgaaatccaaatttcagggcccatcaatggtcacacgattatgtgaatttactaaaaaccattgcatcatatattttaaagggtggactgtatggtttgtgaattatatctcaataaagtagttcttaaaaaaaaacaaaacaaaatttcagggcccatcaagttatatatatatgaaatatatattttggtagatatggggtcttgctatgttgcccaggctgatcttgagctccagggctcaagtaagtgatcctcccacctcagcctcccaaaatgctgggatttcaggtttgaaccaccactgtcatccccataaataaagttattggaatacagccatactcattcattcatgtattgtctatggctgcttttgctctacaatagctgggttgagtacttggaacagagaccaaatgtctggcaaaagtctaacatatttactatcttgtacagaaaaaaaatgtcaacctacatctatacttattacaatttcagtaaaaatacagagtttaagtaatttgggaaaatggctttaagaatgaaaaggtgcaaggttatacctgctgaacaaatgaactgtgggcgtgaggtgccattagtctaggcctgcatgttcagggaaggcccaggggagagcctgatgtggcctggctatttgtcatatttgcaaaggggaagtgatgtaattggtctgcaatgaacttgattttcaattgactcaaagatctaaggaggaataaaaattatttaaaaaggaaattagggaagaatggggagaatattggaatcatttaatagaagtacaaacacatagacttttaacttttgcccattaaattttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctcttaaaaggttgatatggtgtatttttagaatgttttagactgcacgtgtgtgtgtgtttgtttgtgtgtgtgtgtgtgtgcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctccaacaagggaatgctttattagagtttcctagaaataatgggactaattaggacctttcatattacctagtccagcagtccaacccatgtg

SEQ ID NO: 14116 - DNA, 304 bp, Homo sapiens
ttttttgttttgttttgttttttgagatagagtctcgctctgttgccctggctgaaatgcagtggtgcgatctcggctcactgcaagctccgcctcctgggttcacgccattcttctgcctcagcctcccaagtagctaggaccacaggcgcccaccactacgcccagctaattttttgtatttttagtagagacggggtttcaccgtgttagccaggatggtctcgatctcctgacctcgtgatccgcccgccttggcctcccaaagtgctgggattacaggcgtgagccaccacgcctggcc

SEQ ID NO: 14117 - DNA, 10944 bp, Homo sapiens
actttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtgga

SEQ ID NO: 14118 - DNA, 43391 bp, Homo sapiens
gcaaatttccaacagcatccaccctggcagtacagcgagtccgtaggaactggtatggtaattttcctgagctccctaaaccccagcatgtatcaatgtattccacttttgcatattttgcttcctatagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatggtgagtggtaaacatacctacatttccatatttttctttttgccttgagtagtggttgcaacattcatgtataagttagttaaactgaaaataaagtgaaacctaataacccattacatgttttaaagttatttcttaggccaggcgcagtggctcatgcctataatcccagcactttgggaggcccagggggtggatcacctgaggtcaggagttcgagaccagcctggctaacatggtgaaaccccgtttctactaaaaatacaaaaaattagctggctgtggtggcgcacatctgtaatcccagctatttgggaggctgaggcaggagaattgcttgaacctcaggggtggaggttgcagtgagctgagatcatgccattgcactccaacttgagcaacaagagcgaaactgtctcaaaaaaaataataataaagttatttctttcacccctaggtgttcaatgttcaattcatatatgaataactaaaaatattcttagccaggcgtggtggctaacacctgtaacttcagcactttgggaggctgagacaggagaagtgtttgaactctggagtttgagaccagcttaggcaacatagccagaccttgtctctactaaaaatcaaaaaaattagccaggcatggtggtgcacacctgtggtcccagctattcaggaggctgaggcttgagccctagggattgaaacttcagtgaaccatgaccgtgccactgcactccagcttgggcaacgtaacaagactctgtctcaaaaaaaaaaaaaaaaaaattctttactaagttcctccagcatatatttttttaatgttttctggtgtattataaaggatgttatgaaggatacgaatgaacagccagatgacaagatacctgggggcaaaggttttagagccactgtgccctttccaggcctgccaccctcctcccagcacctccatgcattcagcaacctgaaagctcccctctaatagatactaaaacaggagctgtctacataatggctttgataaaaaagcttttttaaagcaataataatattgaacattttttctgtactgtgcactgttctaagctctttatataactcatgtaaccacaatagctctactaaaatataatttaaaatatagtaagaaaagttctgtaggtagatggtgatgatggtgatggttgcacgacaacacgactgtacttaatgccactgcactgtgtacttaaaaatggtcgagtgcagtggctcacacctgtaatcccagcattttgggaggccaaggagggcggatcacctgaggtcaggagttcaagacaagcccggccaacatggtgaaaccccatctctactaaaaatacaaaatttagccaggcgtggtggtgggcatctgtaatcccagctacttgggaggctgaggcaggagaattgcttgaatctggggggcagaggttacagtgagccaggatcaagatcacaccactgcactccagcctgggtgacagagtgagactccatctcaaaaacaaaaacaaaaaaaggttaaaatggtaaattttgtgttacatatattttccacaatttatatatatatatatatataaacatatatgtgtatatgtaatagtaaactttgaaaacattatgcaaagtgaaagaagccagtcaaaaaagactgcatggtgtatgattccatctgtgtgaaatgtccagaataggcaaacccatagagatagaaagtagattggtggttttctagtacaaggagactttgggggaaatgaggagtgactgttaatgggtacggtttactttttttttttttaattttttttttgagacacagtctcactctgttgcccaggctggagtgcagtggagcaatctcggctcactgcaacctctgcctcccgggttcaagcgattctcctgcctcagcctcccgagtagctgggactacaggcgtgtgccaccagctccagccaatttttgtatttttagtagagacggggtttcaccatgttggccaggatggtctcgatctcttgaccttgtgatccgcccaccttggcctcccaaagtgctgggattacaggcgtgagccaccacgcctggctggtttgctctttagagtaatgaaaatgtcctaaaattgatggcagtgatggttgcacaactttgtaaatatattaaaaaccattgaattgtactctttaaataggtgacttgcatggcatgtgaattagagttcagtaaagctgttctaaaatctgtgtgtgtatatgtatatataaaacagcagacttgcctttgcagattttgaaatgtgataatataagagttttctttctttctttctttctttctttttttttttttttttgagacggagtcttgctctgttgcccaggctggagtgcagtggcatgatcttggctcactgcaacctccgtctcctgggttcaagcaattctcctgcctcagcctccccagtagctgggactacaggtgcgtgccaccacgcctggctaattttttgcatttttagtagataaggggtttcaccatgttagccaggatggtctcgatctcctgacctcgtgatctgcctgcctcagcctcccaaagtgctgggattacaggtgtgagccactgcgcccagccttataagagttttcaaaacccacacagattgaatttaaaaacaagaaaaaaattgatcagaaactaaagttcataatggtgatactgaggcaatataaaaagcattaaatgacttctcaatcattaaaaattaaattacatatacttcatatacttttagatttcactgtatcctcttatgatatgctgttttttttttcaactagcaatccatgagcagaataaagaactcatttaattgtaatattgatataaatagctccattccctactgtgttgctcaggctagagtgcaatggcttgatcatagctcactgcagctccaatctcccaggctcaagccatcctcccacctcagcctcctgagtagctgggaccacaggtatgtgccaccaagcctagctaagttaaaaaaaaattttttttagatctcactttgttgcccaggctggtgtcaaaatcctgagctcaagcagtcttcccacctcagcctcccacagtgctgggattacaggtgtgagccactgtgcccagcctataactctagtcctggataacttttaaaaaccttatatgagagttcagcacaggggctgaggaacacagttcctgcaggcagcaagctatgagcctgggctcttgtagcagagagcagaaggacgccaggaataagcattttttttttctgttggccatgagtgtttgtcactcttaatgattgctgttctcctgtgccctctcctgttcttagttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtggtaagcttgagctaattgaaaaccattggaacagaatctgtgccctcgcttcagggtgcaatgttaaatgctatcttccagcaggtcttgagtgagggagtttttccttcagccacttgactaagttaggtttaaatgcaatatgttgaaaacagaccctttaagatatcactgtgttcttagcaaggtcagacatttatggcatttgattactggttgacacttcagctttacattctaaattcgaaccttagtcttcatataacacaagcatctctgtcagccctcatatcgtaatggatcctttggccttttctaagaccaactatgttgccttctatttctgtgacgttagttcctagaccagtgctgtccaataaaattttactgccttcctcggcctgatttacttccatactaaatccatctgctccatgtgtgtatcccaacctgtcatgtgataaacctatcgttttgacatgcttggctatatttgggtactttacctatttatttatttttatttttttattttgagatggagtctcgctctgtaacccaggctggagtgcagtggcacaatctcagctcactgcaacctctgcttcccaggttcaagtgattctcatgcctcagcctcctgagtagctggaattacagatgtgtgccaccatgcctggctaatttttatatttttagtagagacgggggtttcaccatgttggccaggctggtctcgaactcccaacctcaagtgatccacccacctcagcctctcaaagtgctgggattacaagtatgagccaccgtgcctggcctatttatttttttatatatatatatatatatatttttttttttgagaccatctcactctgttgcccaggctaaagtacagtggcaccatctcggctcactgcagcctccaccttccaggctcaagcagttctcctgcctcagcctcctgagtagctgtgattacaggcatgcaccaccacccctggcaccaccacccctgaatttttagtagagacagggtttcaccatgttggccaggctagtctcgaactcctgacctcaagtgatctgcccacctcagcctcccaaagtgctgggattacaggcatgagccatcgtgcctggcccctatttgggtactctctttttttttccttgagagaaggtctctctctgtcgcccaggttggagttcagtggcgcaatctcagctcattgcatcctccacctcctgggctcaagcaattctcgtgcctcagcctcctagtagctgagactacaggtgcatgccaccacgcctggctagtttttgtgttttttatgaatattagagactgggtttcaccctgttggccagggtggtctcaaacttcagacctcaagtgaccaacccacctcagcctcccaaagtgctgagattacaggcatgagccactgtgcctggccctatttggatactttaaaaatgtttgtttttgtcttataaccaacagcagtgataattccctttagaaactccaaagcccagattggcagttgatcttccagcaccttttagagttgtgatggatcagaaggacccttcccctggcccattcctccaaggatattctgagtcagtgcaaaagggaacagctcatgaaatatagtgagagtcatggtagcctctagaacacatcagattaaatttctctgataactcaagtattggacattttgctaccagagcccctttctgattctttccatctttggaagagctacttttgctggactccaggaagtggcatattaccttagccctacatctgcctatgcctgggtgtatttgtacccttcgttgggccagtgagattaaagattttcaactctgcctacacatcacatgacctgggagtttgtaaagatgctgggtctgtttccctggaggctttcattgagtatgtctagttgggatccaggcatgtgtatttcgaaaaagctccacaggtgattctgccttgcagctggggtgagataccccaagacgcagtgagggacttcagattctgtccatgcttttctcttatcagacagcctctgtcatgcttaccttgagaaggaggcttcccctccatcttcctgggatagagccttgataaataaaatcatttttatctgatctacatttggaaaaacactgaccttgttcccacagttcctgctttgccaagaaagtaatagaagccctgaataagttcatgccatcatgtgcaaaataagaaagagaaggctagagatcttatcaaataaatcttaagaatttattttacttcccccagatgtaattcacctagtgagaggagccgaatgcttcctggaactttgccccatcccccccaattccctccactctcctagctcttgtctcagccagtacagctctgccacttccatctggtacgttacatcgactggtgtctgaaacaccctgcttctgtacttctcactattgacgttttctttagggtagcctcttagactttttttttttagctcattcaggtccttaggagacaagagaaagtagaaaggtccagtttattccagacatttatttacctgaaagggcagttctcacccaacccagaatgcaagtgtagggtagagagaggggccactgggtttgtccttggccttggagagcttgggtcattccaagtggcaagtcagagatttagttctgttcttagggcagatcagagggtattggttataggctatgtggctataggagattgggcccactctataggagattacgccctggggacactgtaaaaggactttcggggaatcagtggatcagagacagcctgacactgagaaggctttcccgtgttctcctgaactctcaccagcaccctccacccattacggatcagatatgtggctgaagcaaggtcgtcagagtacaggagcctcttagcatgtcaggaacagtgtcagccctcccatggaatttctgtctaaatggagtatggatgggtttttaacctctgaaataaacactaagttcgtatttattttatacctgtaatagtgtcttctttctgcaaaaaaaaaaaaaaatggcgaaatgctttccgtcaaactgacatgtacagcttttcttctgctctgtttagccccaagatgtgacattagccaaatgctttgtcattttggaacccacttaagtttcatttaagtttcacaacttactgagctaagataggtacgatgactattaatattattcccattttattgatgatggcactgaggcccattatggctttgctcgtttgcacagggtcacagtgtctgaaacagacactttggtttctcgagtttgcccccacgttgtaacccagtattgtcaaattactcaatgtaagaaggcaacatcattttatatcataacactcttaaattacttgttataataaatctcaactgtccttcttatgcttttcctctcaaaaagtttaccagcatgcatgtgggagctccacctttcgggacattcatctctcattcctgtccctccatcagattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggtaatagtcactaatttttgaactccctcccatgcaccagccactaatgcaatgtttctctgtaatctttttacatttgtagctctagctttccttagggtttccccctgtgtttccatagtcatcttattttgtgttaattatgaaatctatgtgactagctgcttgtattttcaatgggaagcaagacaaacaggtactgcgaaggcaggttgagaaaagagatgggaaaggaggtgaatggcaggcttaagacctttgtgggggtgttcacactgtcctcatgatccagtgatgctgccttaagtggggagccagtggccaccagccatgcaggccatgcagctcactgctgtaaagcacgagaagccatgtgagggggtctcatgccaacttttttctattctttttttttttttttctcatacagggtcttgttatgtcacccaggctggagtgcagtggtgcaatcatagctcactgtagcctcaacctcctgggcttaagtgatcctcctacctcagtctcctgagtagctgaccagaggcatacaccaccacacccgactaatttttgtattttttgtagagacagggttttgccgtgttgcccaagctggtgtcgaactcctgggctcaagcgatctacccaccttaccctcccaaagtggtgagattacaggtgtgagccaccatgcctggcttctattcttctatgtttgggttttcatcgtcgagctgatgggcctgtagggtaagagcaaacgttgtaacataatcttctttcttcttggcacaagagggtattgtgaaatttttttttttttttgaaacagagtttcactttgtcacccaggctggaatacagtggcatgatcttggctcactgtaacctctgcctccctggttcaagcaattctcgtgtgtcagccccctgagtagctgggactataggcgcacgccaccatgcccggttaattttttgtattttagtaaagacagggtttcaccatgttgcccaagctggtctcaaactcctaagctcaggaaatctgcccgcctcgcctcccaaagattcacggcctcaccacgcccggccgtgaatcttttttgagatgaggtcttgctaggttgccgagggctttgaactcctggactccagcagtcctcccacctcaggcttcccaagtggctggaactgtgggtgcacaccatcatgcctagctgttttgtgaaccgttgaccagtgcttctctctgcaggatagaaagttcagtgtggttaggagttaaatgggaagaggaaatgcattctactgctccctcattagctaaatatcctgggttcgaaggccttcctcagagtactgacttctttgataatttccctctaaaggactaccctttgtaaaaagtaaagtagaggttcttctttaaagactttccttattatttaattaggaataaatagtaacttcttttagaagcaaaatttatttaaagacctgtgctaaattttttgttgttgttgttgttgagacggagtctcattctgtcgcccaggctggagtgcagtggtgcagtcttggctcactgcaagctccacctcctgggttcacgccattctcctgcctcagcctcccaagtagctgggactacaggcatccactaccacgcccagctaatttttttgtatttttagtagagacagggtttcactgtgttagctaggatggtctcgatctctcgatctcctgacctcgtgatacgcctgcctcggcctcccaaagtactgggattacaggcgtgagccaccacacccagctgacctgtgctaaaattttttttttttttttttttgagatggagtcttgctctttcgtccagtccagactgcagtggtcctatcttggctcactgcaagctccatctcctgggttcgcaccattctcctgcctcagcctcccaagtagctgggactacaggcgcctggctaattttttgtatttttagtagagacggggtttcactgtgttagccaggatgatctcgatctcctggcctcgtgatccacccgccttggcttcccaaagtgctgggattacaggcgtgagccaccgcgcccagctatgctaacatttttaaatatttgctagctgcaataaagaaattaatgtattttatgtttttagttcctgcaatttagtctaaatatttgccttggcctgctaatactggtccaagcaagtattgggtcatagcttgttcctcttctttatttgaaggtgtttttatttttctcagcattttacaagttacttccttcttcctttgttttcctctacctttgcctcttttaaaaagttttaagttgctagccaattaggacaaatacagaatgtaaagtctcgttccagccaatggaaactggacacagcagtaggatggatgcgtcagcttataaatgaccctgtctcctttgtttggtgtactgttgtggcaaaactgctggtgagtgtaccctttctgcaggaagtaaaaatggccttgctgagtaaattaaatttatgttcaagtgctatgtctttgtggcaccggggaacaaacatttcagacacctcctaggaaacagataggagcccctgaggccaggattgactgctggcacctgttcaatatatattctctgcacctgtactaccatgaattgtaaaattaaaaatatatacgtgtatatattctcaacatcctgtgaaaggaagggaaaaataacaacaacaaaaaatatacatctacatattctctctgaaaccaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggtatgtgggcttctttcatgttttggtagctctctccaaggcgaaggttttggtctgtttctcacttttcaaccctaatggaatgggctggagacaaagaagctttacagtgaggaaaatagccattgggcctggtgcatcggagcactgctttcagttttgcttgggaaaaagcattaacttccctatttatgcatctccaaaagtgtacctatcccactcttacacctgagagtgtggtatggcagtggttgcctgctttcaacagggagaggaacttggggactgcagtgtgtgctcagaggattttacagtttctaatgctttgagacgacagcccattttgtgaagacgacttagaagttacatcggcaggcgggtgcggtggctcacgcttgtaatcccagcactttaggaggccaaggcaggtggatcgcgaggtcaggagtttgagaccagcctggctaacttggtgaaaccctgtctctactaaaaatacaaaaattagctgggtgtggtggtgggtgcctgtaatcccagatactcgggaggctgaggcaggagaattgcttgaacccaggaggtggaggttgcagtcagccgagatcgtgctactgcactccagcctgggtgacagagcaagactccatctcggggggaaaaaaaaaaagaatttgcattgctgaccggggcgtagtggctcacttctgtaattccagcattttgggaggccaaggcaggtggataacttgaggccaggagttcgagaccaggctgaccaacatggtgaaaccttgactctactaaaaatacaaaaattagctgggtgtggtggtgcacaactatagtcccagctgctctggagactgaggcacaacaattgcttgaacctgggaggcagaggttgcagtgagccaagattgtgccactgcactccagcctgggtaacagagtgagactccatctcaaaaaaaaaaaggaaaagaaaaaaaaaaagggctgggcgcagtggctcatgcctgtaatcccagcactttgggaggctgaggcaggcggatcacctgaagtcaggagttcgaggtcagcctggccaacatggcaaaaccccatctctactaaaaatataaaaattagctaggtgttttggcgggcgcctgtaatcccagctacttgggaggctgaagcaggagaattgcttgaacctgggagactgaggttacggtgagctaagatagtgccactgcaggcctgggtgacagagcaagactccgtcccccccccaaaaaaaaaaggaaaaataatgttgctgggtgtggtagctcacccctgtaatccccagtactttgggaggccgagatgggcggatcatctgaggtcaggagtttgagagcagcctggccaatatggcgaaaccccatctctactaaaaatacaaaaattagccgggcatggtggcacatgcctgtagccccagctacttgggaggctaagacaggagaatcacttgaacctggaaggtggaggttgcagtgagctgagatcatgccactgcactgcagcctgggcagcagagcaaggctctgtctccaaaaaaaaaaaaaaaagttgcatgattttaaaacgcaacaaattgtctccatttcttggagacaagttttctctttcctccttcacattcccccctcagaaaaccaggtgccttgtgtgctttagaggacacttttgggccaggggtggtggctcatgcctgtaatcctaccactttgtgaggctgaggtgggcagatcacttgaggccaggagtttgagaccagcctggtcaacatggcgaaactccatctctactaaaaatacaaaaattagccgagtgtggtggcgcatgcctgtagtcccagctactggggaggctaaggcagaatcgcttgatcccaggaagcagaggttgcagtgagctgagatcacgccactgcactccagcctggacgacagagggagagtccatctcaaaaacaaaagaaaacaaaaaagaagacttacaaaattttttaaattaaattaaattaaattttttttgagatggagttttgcccttgttgcccaggctggagtgcaatggcatgatctcagctcactgcaacctccgcctcttgggttctagtgattctcctgcctcagcctcccgagtagctgggattacaggcacccactaccatgcctggctaatttttgtatttttagtagtagagacggggtttcaccacgttggtcaggctggtctcaaactcctaatctcaggtgatctacccgccttggcctcccaaagtgctgggattacatgagcctccgcacctggccaaagaagacatttttcccaggtaataaaggcttcacccacttgctccgtgaaaaaggcttttattgatggagtttcatgttaggatgttttccagcaattggattattggtagtggcctctgcacagctgaggcgcccactctggccagccagaagaactcaggccgagttctgttgcttgcctactcttctaaccaagtgaaatcagtctatacccagggttcagtcttcttatggagctgagaatgaattagtttcacctcagccaggatcctgcaagggagccacagaattcagcctagtgcagtgggaaattacatctcatgaaagcagctttgggtcaggccgaaggcctctgtgtcactcctttcagctgtcccagcagtgtcaggcagagggacgtgcaagggcacctttcatcctcaggcttaaagcattccatttggcaagatgggttgccatggctgcgtttgtgcttgataaacagaatgaacatgtttttattcatggagcaggagctggcaggaaggacaaaattggacacctgcacaaactgagaaaattactgtggtataaaatgaatggcctttgacaaactgtagtggcatgtgatcctggacctgagttggcggagtgtagacctgggactcagtcactcctagtaggcagagaagaggtacttttcttgcactgcatggcagatgaggatattttgaagcccaaatgcagaactcattagaaagaaagaatgtctgctcagatctgtcctccagggctggtttgagttttctttgttttcaaacttgcaggcccattggaactacttcagtttgatcacgggcagtcaaatccaacttactacatcaggctggctaatcgtgatctagttctgaggaagaagcccccagggacactccttccatctgcccatgccatagagagggagttcaggtaagttttcagggccaggggagcacttgcccactagcctccactgtgcacaagctcagccctaaactgaaaagtcagcactccataaaaataccccaagacatttaaaactacaattatgggccaggcttggtgggtcacacctataatcccagtgccttgggagaccgaggcaagaggatcattgagcccaagaggtcaagaccagcctaggcaatgcagcaagaccctgtttctaccccccatccccccccaaaaaaaagcctgggtgtgctggcatgaacctgtagtcacacctactcaggaggctgaggtgggaggattgcttgagctgggaggttaaggctacagtgagttactgtggcatcattgcactcccacctgggagacattgtgaaaccctgctccaatcccccaaaaagccaaatgtaaattagaactattctggaaaacaatatgatacaatttattaaaagcctcagcgttttcatactttcagacctaataattccaattctggggctctgtcttaaagaaataattctaagtagggggaaacagctgtatgtattaatatgctcaccataaagttgtttaataataagaatttggaaggccaggagcagtagctaccatagtcccagcactttgggaggctgaggcaggtggatgacttgaactcaggaattgaagaccagcctggacaacatagtgaaaacctgtctctaccaaaaatacgaaaaattagttgggtgtggtggcacatacctgtagttccatctactcaggaggctgaggtgggaggatctcttgaacctgggaggtggaagctgcactgagccgaggtgggcaccactgcactccagcctgggtgacagagcgagactgtgtctcaagaaacaaacaaaagagtttggaaactacttaaatatactataatctgtaccataatcaggaaataattaagtaaaccttggtatatatactgtcgcaatgacagtaatagtaatagctaacatttatcgaatggttaatatgtgccaggcactaaaataaatgcttcgaatgtctgttactgcagagcatcctcacaactctatgatatgttacaattatagtcctcatttacaactgggaaaagtaagccttaaagaaaccaaggcaggcagatttgctttgagctcaggcgttcgagcccagcctgggcaacatggtgaaaccctgactctacaaaaaatacaaaaattagccgggtgttggtgacttggacctgtagtcccagttacatgggaggctgaggctggagaatcacttgaacccaggaagcagaggttgtagtgagctgagatcgtaccgctgcactcacaaagtgagaccctgtctcaaaaaaaaaaaaaaaaaaaaattaaccagcatacccagggtcataaaactagtaagcaagtgctagagtctggctttatagccagtctgtgagatttcatagctcacctttaatgattatgctgttattgcagctaataaaagtatgcctataataacaaatgtgtatgataaaattttaagatagtaaaggcagatacaaactgcatatatagtattagctgattttttttttttttttaggcagagtgtcactattgtccaggctggagtacagtggtgtgatgatacctcactataatctcgaactcctgggctcaagtgattctccgcctcagcctcccaaatactacaggcacatgccatcatgcctggctagttttaaaaatttttttgtagagatggggcctcactatattgcctgaactcttggcctcaagcaatcctcccaccttggcctcccaaagtattggggattacaggcatgagccagcgtgcctggccaaggtttttgattattaattcaatttaacaaaaatgttgttactcagatattttatttcatcttgttttagatttggtaagttgtaatttctaaggagtctgttcatatcacctaagctgttgaatttatgatttataatattcccttactatccttttaatatacgtaggatctatagtgatatcctttttttttttttttttttttttttttttttgaaatggagtcttgctttgtcatccaggctggagtgcagtggcatgatcttggcttattgccacctccatctcccaggtccaagtgattctcctgccttagcctcccaagtaacagggattatagtcacacgccaccatgtccagctaatttactatttttagtagagatggggtttccccatgttgaccaggctggtctacaacccctgatctcaagtgattcacctgcctcggcctcccaaagtgctgggattacaggcgtgagccactatgcccaccctagtgatatcctttctttatcactgctggtattaactgataatttgtattctctctctcttgttagtctagctagggatttatcaattacattgatctgggaaccacagtttggttttgttacttttttctattgtttgttttgttttgaggcggagtttttgctctgtcacccaggctggagtgcagtggcgcaatctcggctcactgcaacctctgcctcccaggttcaagtgattctcctgtctcagcctcctgagtagctgggattacaggcatgcgccaccatacccaggtaatttttgtatttttagtagagatagggtttcaccatgttggtcaggctggtccgaactcttgacctcgggtgatccgcctgccttggcttcccaaagtgctgggactacaggtatgagcctctgcgcctggcctgtttttcttttctaatacaagcatttaaatatataacttttaaggctgggcgcagtggctcccacttgtaatcccagcactttgggaggccgagccaggtggatcacctgaggtcaggagttcaagaccagtcttgccaacatggtgaaaccctgtctctaataaaaatacaaaagtaagccaagtgtggtggtgcacacctatagtcccagccaatctcgaggctgaggcaggagaatctcttgaacccaggaggcagagattgcagtgagcggagattgcagtgagccaagattgtgccatggcactccagcctgggcaacataatgagactctgtctcaaaaaaaaaagaaaagaaaaaaagaagtgcattgtttaattttcaaatatttgggggtttttttcttgatattatatgtgaatgaattctagtttaattccattgaagtctgacaaataccctgcaagatttcaattttttggttttttttgagatggagtcttggtctgtcacccaggccgtagtgcagtggtgcgatcttggctcactgcagtctccacctcctgggttcaagcaattctcctgcctcagcctcctcagtagctcggactacaggcacataccaccatgcctggctaatttttgtatttttagtaggtatggggtttcaccacttcggccaggatggtctcaatctcctgacctcatgatccacctgcctcggcctcccggagtgctgggattacaggcatgagtcactgcgcccggccttttgtttgttattttttgagatgcaggtttgctcttgtcgcccaggctgcactgcagtggcatgatcttggttcattgcaacctccgcctcctgggttcaagtgattctcctgcctcagcctcctaagtaggtacaattaaaggcatgaggcaccatgcccggctaatttttgtattatttttattattttttgagacagagtctcgctctgttgcccaggctggagcgcagtggcacgatctcggcccactgcaagctccgcctcccaggttcacgccattctcctgcctcagcctcccgagtagatgggactacaggtgcccaccaccactcctggctaattttttgtatttttagtagagacggagtttcaccatgttagctaggatggtctcgatctcctgacctcgtgatccacccgcctcagcctcccaaagtgctgagattgcaggcatgagccaccaagcctggccctaatttttgtatttttaatagaaatggggtttcgccgtattggccaggctggtgttgaactcctgacctcaggtgatccgcccgcctcggcctcccaaaatgctgggattataggcatgagctagtgtgctgggctagattttaatttttattgaaattttttgagatttattttatggaccagcacatgacttatcttggcgaacatattgtgtttacttgaaataatgtgtattttgcaatatctgagtgagtggtatacaaatgtccatcagatcaagttggtagtgggttcagatgtatgtctttagataaatctatttttgtctaattctatcattactgagaaaggagtgttaaaagctcaactaagacttgtggatttctccatttttttctctttaattttgatcatttttacttgatatatttcgaagctctgttgtttagcacatacatacttatgattgtaatatctttctgatgaacttgcagttgtatcattttcaaatgtccctctttatctctggtggtacactgtcgtaaaggctgctttatttgatattaaagtagcctcaccagctttcttatgcttagtgattgcataatgcttccatttccatccttgtttttgcagcctatctatgtttatatattcagcgcatatctcttgtagacatcatataattaggtcatgtttttctgtccaggctgaaaacatctgtcttttatttttattttatttcttttatttattttattttatttttttttgagatggagtctcgctctgtcacccaggccggagcacagtggagcgatcttggctcattgcaacctccgcctcctgggttcaagtgattctcatgcttcagccacccaagtagctgggattacaggcacgcgccaccatgcctggctaatttttgtatttttagttgagaaagggttttaccatgttggccagggtggtcttgaactcttaggctcaagcagtcctccccctcagcctcccaaagtgctgggattacaggcaggagccaccatgcatggccaacttctgtcttttaattggaatctattcatcttttgagtttaatgtaattattgatatgtttgatttaggtctacaatttcaccattggttttttgtttgtcccatcatttttttgttcttacctacttttgggtcaattgaatattttttagaatttcattttaatttatgtaccatttttaattcagaaaagtaatttcaggccaggcacaatggcttatgcctgtaatcccaggactttgggaggccggggcaggtggatcacctgaggtcaggaatttgagaacagcctggccaacatggtgaaaccgcgtctctactacaaatataaaaattagctggttgtggtggtgcacatctgtaatcccagctactcaggaggctgaggcctgagaatggcttgaacctaggaagtagaggttgcagtgagccaagatcgtgccactgcactccagcctgggtaacagagcgagactgtgtctcaaaaaacaaaacaaacaaacaaacaaaaaacaaagaaaagtaacttcaagaaaatctcatcaattcagccagcaattttgtttattttcatttgtccttgcaggattatgaaagcccttgcaaatgctggagtacctgtccctaacgttcttgatctctgtgaagattcaaggtaaagttcagatgtttttgctattgcactttcaagctacaggagagaaaagcccatatgctaacacaaattccaatttgttaaagacaaataaaatttgggtaggagggaaaagaaactttatcacaacctctcccagaagttctcagatatttaagttatcctgcaagataagtatatgcctgctttagggataattggtagaaaacatcttttttaacattcaaaaaatacatattaatctagtttcatgttgcttgtctttatttatttttttaatcagagtctttctaaactgttttgttttgtttttttgagacggagtctcattctgtcacccagactggagtctcattctgtcacccagactggagtccagtggcctaatctcggttcactgcaacctctgcctcctgggttcaagtgattctgctgcctcagtctcctgagtagctgggattacaggtgccccctactatgcccagctagtttttgtaatttttgagtagagacagggtttcgccatgttggccatgctggtctccaactcctgacctcacgtgatccacccactttggcctcccatgatgctgggattacaagtgtaagccaccgtgcccggccctaaactatttatttatttatttatttatttatttattttttattgataattcttgggtgtttctcacagagggggatttggctgggtcataggacaatagtggagggaaggtcagcagataaacaagtgaacaaaggtctctggttttcctagcagaggaccctgcggccttccgcagtgtttgtgtccctgggtacttgagattagggagtggtgatgactcttaacgagcatgctgccttcaagcttctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggtggccgggcagaggcgcccctcacctcccggacggggcgggtggccgggcggggggctgacccccccccacctccctcccggacggggcggctggccgggcagaggggctcctcacttcccagtaggggcggccgggcagaggcgcccctcacctcccagacggggcggctagccgggcggggggctgacccccccacctccctcccggacggggcggctggccgggtggggggctgaccccccctcctccctcccggacggggcggctggccgggcagaggggctcctcacttcccagtaggggcggccgggcagaggcgcccctcacctcccagacggggcggctggccgggcgggggggctgacccccccacctccctcccagacggggcggctgtccaggcggggggctgacccccccacctccctcccggacggggcggctggccgggcggggggctgacccccccgcctccctcctggacggggcagctggccgggcggggggctgacccccccgcctccctcccggacggggcggctggccgggcagaggggctcctcacttcccagtaggggcggccaggcagaggcgcccctcacctcccggacggggtggctggccgggtggggggctgacccccccacctccctcccggacggggcggctggccgggcggggggctgaccccccgacctccctcccggacggggcggggggctgacccccccccccacctccctcccggacggggtggctgcccggcggagacgctcctcacttcccagatggggtggctgccgggcagagaggctcctcacttctcagatggggcggctgccgggcggagggcctcctcacttctcagacggggcggttgccaggcagagggtctcctcacttctcagacagggcggccgggcagggacgctcctcacctcccagacggggtctcggccgggcagaggcgctcctcacatcccagacggggcggcggggcagaggcgctccccacatctcagatgatgggcggccaggcagagacgctcctcacttcctagatgtgatggcggccgggaagaggtgctcctcacttcctagatgtgatggcggccgggaagaggtgctcctcacttcctagatgggatggcgtctgggcggatacgctcctcactttccagactgggcagccaggcagaggggctcctcacatctcagacgatgggtggccgggcagagacgctcctcacttcctagatgtgatggcgtcacttcctagatgtgatggcggccgggaagaggtgctcctcacttcctagatgggatggcggcggggcggagacgctcctcactttccagactgggcagccaggcagaggggctcctcacatcccagacgatgggcagccaggcagagacactcctcacttcccagacggggtggcggccgggcagaggctgcaatctcagcactttgggaggccaaggcaggcggctgggaggtggaggttgtagcgagccaagatcacgccactgcactccagcctgggcaccattgagcactgagtgaacgagactccatctgcaatcccggcacctcgggaggctgaggctggcggatcactcgcggttaggggctggagaccggcctggccaacacagcgaaaccccgtctccaccaaaaccagtcaggcgtggcggcgcgtgcctgcaattgcaggcactcggcaggctgaggcaggagaatcaggcagggaggttgcagtgagctgagatggcagcagtacagtccagcttcggctcggcatgagagggagaccgtggaaagagagggaggggagaccgtggaaagagagggagagggagaccgtggaaagagagggagagggagaccgtggaaagagagggagagggagaccgtggaaagagagggagagggagaccgtggggagagggagagggagaagactattttaaacagctttgtaacatgctttttgagtgtctcttctttcctaatgttttaattatgtaacatttgaaaccttcagaaaaggtgaaagaagaaaaactaatacaatgaatacctgtttacacttcatctagatcaaaaattaaaacattgttaacattttgccacatttattttctgtatatgtgtgtgtgtatacatgtatacttttaacatgtagataatgattttttttggctgaaccttttgaaataagtttcagacagcatgcatctctcaagaataaagacattgaccgggcatagtggctcactcctgtaatcccagcacttaaggaggctgaggcaggtagatcacttgagcccaggagtttgagaccagccagggcaacatggcaaaaccccatctctacaaaaacaaacaaaaaattagccaggcgtggaggtgcacacctgtagtcctacctacttacccggaagattgtggtgggaggatcacctgagcctgggaggtggaggctgcagtgagctgtgatcacatcactgcactccaggctggatgatagagtgagaccctgtctttttttttttcctttcttttcttcttcttcttttttttttgagatggagtctcactctgttgcccaggctggagcgaaatggcgcggtctgggcacactgcaacctctgcctcctggattcaagcagttctcctgccttagcctcccaagtagctgggattataggcatgtgccaccacacccggctaatttttgtatttttaatggagacggggtttcgccttgttggccaggctggtctcaaactcttgacctcaagtgatccatccgcctcggcctcccaaagtgctggattacaggtatgagccactgcacccggccgacattgtttttcataaccacaacaccagtatacctaactaacaattatttaataataatactgaatatctaacccatgttcaaatttccccaatccaaaacatcttttgtaataatttttcaacttgaaacatttgtaatggtaggattttcaaaacaattttttagagtagtaaactggaggctgaggcagatggatcacttgaagccaggagtttgagaccagcctggccaacgtggtgaaaccccgtctctactgaaaatacagaaattagctgggcatggtggcgctcacctggagtcccagctactttggaggctgaagcaggagaatcatttgaacctgagaggcagagtttgcagtaggccaagatcgcaccactgcactccagcctaggtgatagagtgagactccatctcaaaaataaataaataaataaatagagtagtaaactgtttgctagtaatgaccaaaagatggattagtgacatgtcattgggtcaccttagtactgctgggtggtatatacaccactcataccaccaaaaaatgataaaaataacctcaataacaagaagggatacttattgaacccttattggaaccagagaccatgtcaggcactctgtatgtttgttccctaattcatttctttttttaagtaacaaataccctggaagctcccttaattcttgcaattaccctttgaagtatgtatgttttacagattaaaaaacaacaacatggctgggtgcagtggctcacgcctgtaatcccagcactttgggaggctgaggcggatggattacgaggtcaggagattgagaccatcctggctaacagagtgaaacaccgtctctactaaaaatacaaaaaattagctggttgtggtggcacatacctgtagtttcagctattcgggatgctgaggcaggagaatcacttgaacccgggaggcggaggttgcagtgagccaagatcgtaccactgcacttcagcctaggcaacagagcgagactccatctcaacaacaaagctcagagaggtttaataagtctctcagggtcactcttcaactaagagcagagttgggatttaaacctggttccaaccaggtgcagtggctcacacacgtaatcccaacactttgggaggctgaggcagtcagattacctgaggtcaggagtttgagaccagcctggccaatatggtgaaaccccatctctactaaaaatacaaaaattagtcaggcgtggtggcatgcacctggagtcccaactatttgggaggctgaggcaggataatcgcttgaacccaggagaaggaggttgcagtaagccaagatcgcgccactgcactccagcctgggcgacagagcaagactccatctcaaaaaaataaataaataggccgggagcagtggctcacgcctataatcccaccactttgggaggccaaggcgggtggatcacgaggtcaggagatcaagaccatcctggctaacacggtgaaatcctgtctctactcaaaatacaaaaaattagccgggcgtggtggcgggtgcctgtagtcccagctactcaggaggctgaggcaggagaatggtatgaacctgggaggcggagcttgcagtgagccgagatcgcgccactgcactccagcctgggtgacagagcgagactccgtctcaaaaaattaaaaaataaataaataaataaacaaaaaataaaaacctggttcggtgtgactccagaggtccttctctgagccttgctgcttgctacattattacactttgaatccattcctgtggcttacacaaatgaaccagggagaagagaaaagcatgctgtccaagaagcatagatgggtgtgcatgtgtgtgtgtgcacgtgtgtatgtatatgtgtgtgtgcatgtatgtggatcgatccattgcaagagaggatacttctaatgcactgtgcttatgtgaaaggaaaaaggaagtatccagtgctctgggtctgaactcttcaccagctctcaacctgtatacccagggaaagtgacaaagaatagggtcatgactaacagcctgccacattatgactctgatccctgaaaccccttctgtgttcctcccagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggtgagcaggaggccacgtctcccatgctggttgtttcatcactagtgcttctgcttttaggatctgaatcgttttgggtcgttttgagtattagcacaccaagcgtaaggcagacttagcttcttccttggaaatccagtttagttttaatggaggtgttgctgacttaggcatttgggccttcaataaatccctttatgaactacacagtctttcttccctgcaacttttttttttcattttttctttttttcccttaaatattctgctatccaattccctgcaacttttatctcactagaccatttaaattttttttctgatactgaccataggtatttaaaatgtatttttctccgttttttaccctttcccctaaatattcttttcaacaggaatatatgtattttttgagatgggggtctcactgtgttgcccaggctggtctcaaacttctgggctcaagccatcctcctgtctcagcctcccaagtagttgggactctgggcatgtgccaccgtgtccagtttcaacagggatagtttttttgtttgtttgttttttgagacagggtctctctctgtcgcccacactggagtgtagtggtgtgatctcggctcactgcagcctcaacctcttgggctcaagcaatcctcctgcctctccctcttgagtagctgggactacaggtacgcaccaccatgcccagctaatttttgtatttttagcagagacaggtttttgccacattgcccaggctctacccaaactcctgcgctcaagtgatttggcctcccaaagtgttgggattacaggcatgagcctctgcagccagccctcatgtagttcttaccacatgccaagaatagttctaagggctttacatattttattctcccaacagctctatgaggaccatctcaagatgaggaaactaaagcatagagatgttaagtaacctgcctgagatcacagagctagagaacaacagagctgggtttcatagcctggcagtctggctccagggttcatgtgctcagctaaccactgttgtttagccaaaaagtgatttatgaaaggctattaggaagcacagaagatctttttttttgagatggagttttgctcttgtcacccaggctggagtgcaatggcgcaatctcggctcacttcaacctccgcctcctgggttcaagcgattttcctgcctcagcctcccaagtagctgggatgacaggcacccaccaccacacctggctaatttttgtatttttcagtagagatgcgctttcgccatgttggacaggccagtctcgaactcctgacctcctgcctgcgttggcctcccaaagtgctgggattacaggtgtgagccaccatggccggccacaaggtctttaagaggaccagagatcatacttggagaccatatagctaggaacagcacccagaccacactaatccagccaaagagctggtgacttccaccttggggcagcaggagcatcatgtgggaaattctccagtcataggaacgtgttcaaagacactgcaccacccagtgcagagcatgacaaagggtttcactgcactggtttttttttccgctactttcagaggttgctgaaattgcacaccaagttctaatcctatttcccgcaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggtagatgtggtggcagggagagctgaaaaatgacagcaaggatgctccaagggggaattgagcaattggtcttggtgcaatttacagctgggaattattcctattacaaagcacctgtctgtgtgtggccttttcaggcagggtttctcagctctggcactgtgacatgttgaattggataagtttttgtggtgggagctactgtgcattgcaggatgtcaggcatcatccctggcctcaacccactcgatgacagtagcacccctccccacagagtgtgacaaccaaaaatcttcgcagacctggtccagtgttcccagggagggcagcattcctctgttgagacccactgtttgaaagtaaggcagagtctatggccataccaccctgaacaggcccgatctcatctgaaagtaaggcagagtgagggtgccactcacctcccaagaggcctggggatggacattctcactgggtgtaatgaaaggattgaaagagagtgacagggtctctgggggtatgtgatgagtctgtagcacggctaaaatgggaacttcagtatgcctggcgtctggcggcagtgtctagctttatcttatcatctcttgctgtgaaaactgcccgttaggtacttttatagggtagtgtttatagtgttttctgcttcgcagcacctggagacctgcttttgatgcaagcatgccttatttggcttgtcttcttgcccatctggggactcaggccttttattaaacaagactagacagtgaaggctaattttaaagacatttccgtttcttttttttttttttttagacatcgtctcactcagtcgcccaggctggagtgcagtggcgtgatctcagctcactgcctaccccacctcctgggttcaagcaattctcccgccccagcctcccgagcagctgggattacaggtgtgcaccaccatgtgtggctaacttttgtatttttggtaatccaaaaatacaatacatttttagtaatacaaaaatgtgagatggggtttcatcatattgatcaggctggtctcaaactcctgccctcaagtgatctgcccactttggcctcccagagtgctgggattataggcatgagccaccatgcccagccttaaagacatttctttgccttccaaatttgattggcctctcttcattggcttgaccggtgtccctcgctcccggcttcttccgttagccagccacctttggggatccccctgggtctgagagtggacagctgagctttctttgtcatgtggtcatcacgggagcttgaggaacctgcttctgcatcagagactgatggggccaagtgcttcccccacactgccttgaacgtggcatgcagttgggctgcatttgaccccctcctccatcttctttctccacttgggattctagagcacttgcctgacaacactttccttgccagccattgccatgtatttcctttggcggggaagacctcaggtggcctttgtgtcaccagcccacaacagctgctccgtggaccttgtctttgcttctcttggcacctcaacaatccacgaatgtgatcaagtatacagcaggcaggagatatccagtgcagtctgagcaccccctcccctagctatagtgaagtatgatgatcatttaggatgttgcctccaggaaaggcatcctctgattttagagagcgtgctgctgcttattgatcaacacagtcagagatagttctgtcttttgatggatagaagaacatttcttgctagtggagtgaatcagcggtggtgggagcataaactgctgcagctactttgaaaagtagtaggcagtggccaggcacggtgactcaagcgtgtaatcccagcactttgggaggcgaaagcgggcagatcacttgaggtcaggagttcgagaccagcctggccaacatgccaaaatcccatgtctattaaaaatataaaaattacctgagtgtggtggtgcccctgtaatcccagctactcgggagggtgaggcaggagaatcacttgaacccgggaggcagaggttgcagtgagccaagaccgcaccactgcactccagcctgggtgacagagtgagactccatctcaaaaaacaacaaaaaaagaaaagtaatgggcagtaacatggaagatgggaatatgctacaacccatcgtttcttgtaaagaagcatctgctgcagctttgcaccaagagactcaggtgaagatgtttgttttggtcatgcttgtaattataatacatgataaataaagtgtagtttggccatatgttggaattctatttagtgagtaaaataaaccaatttgctgtacataagtcataagtctcaaaaaagataatcgaagtagaaaaaagtttcaaaagggtaatatatcatttatgaaaatttaaaaataattgaaagaacactatatgtggtatataggtacaggtatagataagagaaatatagaaatgtctgagactgatatataccaacttcagggtagcagtaaatctcatttttaaaaaatctgaagcaaatgtaacaaaaaagcacgtacaatatctgttaaatctggaaggtggacacatgagttctgtcattatgtcattctctgtatttttctgcatgcttgatgtttactttttcttttaaataaagcatgcattacagacagccctggcaggaaacagaaagcatgaaagaggctatctggggagagttcaatatagggttatttagttcaatatagcgtggtttagaggaaccgctgaagaacagcgtggagtcccggggccagtaacagtgaggggtcagtctgacagggcaagcatgtgctgtggttattgctactctacaacaaactttgtcagaactgagtggctgtcaacaacgacagcagtcattttgcttatgaatctttgcagtctggggacaggacagcttatttcaaagtagggcggctgtcgggtggggctggatcttctgaagacttgctagcatgctggccctgggcagagaagatattaacagccgggctccttgggcctctctttctgtctctttgtggttcccacatggtctctccagcatggcaacttctgggtaactggactttttttttttgagacaggatcttgcactgtcacccaggctggagtgtagtggcaattcataggctggaacataactcactgcagccaccaactcctgggctcagtgatgctcccaccttagcctcctgagtagctgggactacaggcgtgcactaccacgctcagctaatttttaaatttttttttgtagagataggatcttgttatgttgcccgggctggtcttgaactcctgagcttaagcagtcctccgaaaatgtggggattacaggcatgaaccattgctctcagccctggacttcttacctgggggctcagggctccaaaatagtgtgtttcaagagacagagggctgggcagaagctgtatcacgttttctgacctagtctagtttcaggaatccctcagcatcacttccacgtgtcttatatctgttagaagcaagatgcttcactgggccaagcattagactctaccttttgtgggaggagtgtcaaaggatttacagatctgttttaaaaccatcacagggagggagtaattcccggaacccagagaggctagctctctggggaaggctgcagagaaggagctggggaaataaataaccaggccctttcccatctcctgcttttgattggctgagtccagctggaagccagagggcaagggagcctttggagcacacagcccagggagctcaggcacccgggcacagaggggatgggagggtggggagccaagcctaaagggcaaacagaccacgcagaatccaccctagccggcagttttcttagtgctgtctctattcctcctgcgacttttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtaggaactgctgctggaggatagtgggggagcaagccagttctccaagcatttgggagcaaactcagctgaagtagtccgtgattgggcgggggaagtgaaagtgaggtcctggtggttctggtgggaaacataactagaatgcagtcctgtcacatttacgggaaagtggatataggatgtgttttaagtgaaaagtatgcctgtataggtaccgcttatgcttttacacagctaacttctatttagggttttaaattaaaaacacattcattgtggctgggtgtggtgtctcatgcctgtaatcccagcacgttgggaggccaaggcgggtggatcacaaggtcaggagttccagaccagcctggccaacatggtgaaccctgtctctactaaaaatacaaaattagctggacgtggtggcgtgtgcctgtaaccccagctactcgggaggctgaggcaggagaattgtttgaacctgggaggcagaggttgcagtcagctgagatcatgccattgcactccagcctgggcaacagggcgagactccatctcaaaaaaaacaaaaacaaaccacatttattgtgaaaatactagagccaacagatagcaacaacaacaaaacagttaaaatcattagtagtcccagagataaccatttgctgacatttcagtatctatccatgtcatcttttcttctgtgtgtatatgtacatttcctaaaacaaaacaaaaatgtaacatgatctaatggcatgctttttttcacttcattgtatactgtagacatgttttcatgacattaagtatttcttctatagcataatttttaatgagagcatataattttattgtatagaattaagggaagacggccgggcgcggtggcccacgcctgtaatcccagcactttgggaggccgagacgggtggatcacgaggtcaggagatcgagaccatcctggctaacatggtgaaaccccgtctctactaaaaatacaaaaaaattagctgggcgtggtggtgggcacctgtagtcccagctactcaggaggctgaggcaggagaatggtgtgaacccgggaggcggagcttgcaatgagctgagatggcgccactgcactcgagcctaggcaacagagcaagactccatctcaaaaaaaaaaaaagaattaagggaagacatttgggttaattcctatttagatatttaatttgtttccaattttttagtattacttcccctacttccatgaaaaaaaggcagtgaacatccttgtagtaatatatttgcctatatataaggtatactcctaagattaatacctaggaatggaatatattacatgcttctaaatcatgaaaatgtcacaactggaggaaataagtgaattttttttttttttgagacggagtctcgctctgttgcccaggctagagtgcagtggcgcgatctcagctcactgcaagctccacctcccaggttcacaccattctcctgcctcagcctcctaagtagctgggactacaggcacccaccaccacgcccggctaaatttttgtttttgtagtagacatggggtttcaccgtgttagccaggatggtctcgatctcctgacctcatgatccgcccgccttggcctcccaaagtgctaggattacaggcgtgagccactgcgcctggcccgtgaaattattttatttgctataattatcattttcataatttggtgagatctttttatttttatatttatttatttatttgtttatttgtttatttatttttgagatggagtctccctctgtcactcgttttatttatttttgagatggagtctcactctgtcgcccaggctggaccacagtggcgcaatctcggctcactgcaacctctgcctcccgggttcaagcgattctccggcctcggcctcctgagtagctgggattacaggcgtgtgccacaatgtctggctaatttttgtattttcagtagagacagggtcttcaccatgttggccaggctggtgtcgacctcctgacctcaaatgatctgccctcctcggcctcctaaagtgctgggattagaggcatgagccactgcacccagccaattgtttttttttttttttttttgagatggagtcttgctctgtcacccaggctggagtgcagtggcgtgatctcagctcactgcaacctctgcctcctggattcatgcaattctcctgtctcagcctccctcccaggtagctgggattacaggtgcacgccaccatgcctggctaatttttgtatttttagtagagacagggtttcaccatattggtcaggccggtcttgaactcctgacctcaggtgatccacctaactcggcctcccaaagtgctgggattacaggcatgagccactgtgctcgacctgagatcgctctttccatatcatttttgatcaaatgactggttgaagataatatgcatccacccttaactgtggccagatggaattggaagctcccattccttcctttactgccagttgagtctgaaacctgtaagagccaatttgtgaataatgacttcatgcctggatccccagccatctaagggagcaagagccaatgcaggaataagctaacccatggaactggtcgtgaaactaatttgcaagggacatggcgattttcagaatttaaatatttgccagccacaggggcgtgtcacgtcagtgactacccatgaatggctctgtctttctcgcaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacaggtaatgggatggctgccctgaagagccactgcggggtgagtcacagcaaggaccgtgcctccacctggaaaccctctcagggccacagaggctttggagagaccgatttggccaggattctctgaggttcagttaatctaaccatttgtccataaatattttctttacaatatttatttatttattatttgtttttgagacagggtcttgctttgtcaccctggctggagtccagtggtttgatcctggctcactgtaatctctaccttctgggttcaagcgattctcctgcctcagcctccagggtagctgggactacaggcctgcgccaccacgcctggctaatttttttttgtatttttagtagagatgaagtttcaccatgttggccaagctggtctcgaactccgggcctcaagtgatccgtctgccttggcctcccaaagtgctgggattacaggtgtgagccaccatgcccagcctctttacaatatttaaacttgttttttaattattaaagtaatgcacaaagaaatttttccagttaaagcattcatgcacatgatcaaaatttggtcatatagaattatgtaaaattgtatctcacccttttcaacaccattcctcaaagataaatgttactgttaagagtttcctgggccctccagtttttctgtttatctgtcttctctctctcctcctacttttacacaaatgtgatcatcctatgtgtatttttcggtactttgattttaaaattttgtaagcttaagaatttctgtgaaatatgtgtgtgaccatttgcatatttaacaactatatgaggcaaatttcttggtgtgtgtgtgtgtgtgtgtgtgtgtgttgagacagtttctcactctgtcgcccaggctggagtgcagtggtgcgatcttggttcactgcaacctccacctcaccagctcaagcaattctcatgcctcagcctcccaagaagctgggattataggcacataccaccatacccgcgtcatttttttgtttgtttttagtagagatggggttttgccatgttggccaggctggtttcgaactcctgacctcagatgatccatccacctcggcctcccaaagtgctgggattacaggcatgagccactgagcccggccagtccccaagtctttaggtaaaacccctgtggtctttgacaacttccttgctcgctagtatgacaaaatgttccaggttcatcttgtctatccagcctacccaacatggtgaaactgtgtctctactaaaaatacaaaaattagccaggcatggtggcgggtgcctgtaatcccagctacttgggagactgaggcaggagactcacttgaacctgggacggggaggttgcagtgagccgagatcgtgccactacactccagcctgggcgacaagaatgagactctgtctcaaaaaaaaaaaaaaaaaaagacttgggagccaacctgaacaggctcccacttgctaacaataggaaactttgggcatcaccaaggatgatagctgaaatggatgaaacacatcaggtatgtttaaatccatgagtagtagccgggcatggtggctcaggcctgtaatcccagcactttgggaggccaaggtgagcagatcacttgaggttagggattcaagaccagcctggccaacatggtgaaaccacatctctactaaaaatacaaaaattagccaggtgtgatggcgggcgcctaaaatcccagctactcaggggactgaggcaggagagagaatcacttgaacccagggggcagaggttgcagtgagctgagatcgcgcctgtgcactgcagcctgggtgactgagcaagacactgtccccccaaaaataaaaattaaataaataagtccatgagtagtgatacaaaaacaaagagacaaagtctcattgatgacctcagaggttgccaggaaagcaacttattattctgaaaattggaaaatggggtgggggggtggggaatcaagcatttgtcctgtctttcctgtacaaatgatactgcaggctatccaaataatcaatgagggaatgtttctctctagagaagtatcctggacagaataatatagaatttgcatatcaccaatttgcaactcctaatgcattaatggatgtgggcaataagcttcaatgaaagccaacaccactgagagacagacagccagacattatatacctcctgatgcttccctcaaaagttacactgactctgcccaggtctccagtgctagctgccaactcatgggaaacacagggttcagagggacatgttcagcagcaccctgggcacagcactcacaaaatccagattctggaaaacatcacagggcaaacaactcagtttcttcaaacacttacatttcaaggggaggaaaagggtgaaaaaggaacctgtagattgagagagacttaaaagaaacatcaggctgggcgtggtggctcacgcctgtaatcccagcactgtgggaaaccgaggtgggtggatcacctgaggtcaggagtttgagaccagcctggccaacatggggaaaccctgtctctactaaaaaatataaaaattagccaggcctggtggcgggcacctgtaatcccagctactcgggaggctgagataggagaattgcttgaacccaggaggcggaggttgcggcgagccatgattgcatcaccgcagtctagcctgggcaacaaagtgagactgtctcagaaaaaaaaaaggtggggggagcggggagagacttaaaagatacgttagccagttacagtgttgggaccttatttggatcctttcttgaacaaattatttggaaaaaattttgatgatagtcactgaaacttgaattctgagtggatagtcgatgatatgaagaagttaacagttaacgattttttaagggtaataatagtattgtgggttttttaaaaaacatttgtttttagagttttgaaagaatcctagatgagatatttgggatttactccaaaaaatccaggacagtgggagtggggatggcagggaatgaaaccagactgggctggcatcgatcattgcggaaggcgagcagtagaacccgtaggcttgttattctctcctctctactcctgtgtgtctttgaaattttccaaaaggaggccagtcatgatggctcacgccggtaatcctagcacactgggaggccgaagtaggtggatcacctgaggtcgggagtttgagacccctggccaacatggtgaaaccccgtctccactaaaaatacaaaaattgcctgggtgtggtgatgccgcctataatcccagctacatgggaggctgaggcaggagaatcacttgaacccgggaggcagaggttgcagtgagcagagatcgtgccactacactccagcctgggtgacagagcaagactccatctcaaaaaaaaaaaaaaaaaggccaggtgcggtggctcatgcctgtaatcccagcactttgagaggccgaggcggggggatcacgaggtcaggagatcaagaccatcctggccaacatgatgaaaccccgtctctactaaaaatacaaaaattagctgggcttggtggtgtgtgcctgtaatcccagctactaggtgtctgtaatcccagctaactagggaggctgaggcagatgaatagcttgaaccagggagtcagaggttgcagtgagccgagattgcttcactgttcactccagcctggtgacagagcgagactccatctcaaaaaaaaaaaaaaaaaaaagaaaagaaaaagaaattttccaaaagcaaaacttaaaaacaaaaggcaaggagaaagaaggagaaaggaattcatcatgggatttgctagtgctgatggagtgtttagctttgcagtcagtgacaccccaagcttgctggcagcctgtgttctcagccaggttgccagagtcttctgagagaagcagttgcagtaggggaattgatcattcattcccaagtatatgagcctctactaaaagccagcactgtgctaggtggtcctggagatacacagtcatgagaaaaactgtccggagaaaaaccagtacccagagaatttctagtttaactgtacctggtctgataagcaggggatgctggaagcaggaatttctggaaacaatattttccctcttttaggaaaatacagtatcagctgtaagccactatttcccattttttttatagttttccaataaacactaaccagaaatatttacttaaacagaatggctgctaagtccttatggtgatgaatagtcctggtcacctctgatatttcctagccggctgccaagttttctccctgctctgctccagtgacctgggaaaagcttaatagactgcccattttagagtctccacactgagtgtcctcagcctgtctctcaggaagccctttgacatgtttttaagatcctgtgagccatcgttgtggcttctggtttctctcggcccagagctaaaacaccccacctgtttgccaccagacagaaaaatgtctgtttgttcaggcctttattcctcttatcttactgtgcactcctttccctccctctgggaagccagccagacacactgaggaaatggcttagttttctcatgtaaaaacaacaaaatccattttttgaaagaataatataaaaacgtatgatgaatggggaaaaaaccaactatacaaacataaatattacttctgtacatttgtcttctacaattagctttaaaatcatttttgtttgaacagctgagatatttggtactggccaggaaaactggagcttagagaaggggtatctgtttccaagacattctctctatggtgtcatttacaaaagacttcaaatcagcattagattgggaaggggatgagagagaccagagcccagtgagcagaagattaacagtatgtacctgcccagcccatgtgtccttctccttccttaataagtgggtgcagaaattagatttctggtagatggccactgaaattctataaagtgcttatgactgcaagttaagtggacaccagtgatgtggtctcttctgctggaactacattttggaaaatataccagaagcaatagatctaaatcaatccaagcttatacaagtgacttttttcagggacaaagtagcagtctcagagtgggagccaaccaaatagaagaaaattaagaatacacctcttactctgttagaagaagaaaatccttatgaataataaggaacataagggagtatctttcccttcaatgtgctgtgtgcagtccgaggaataaggaataagcccccactgtgtgtctgcaaggaagaggctatctggtttctgactgacttccctgggttaggttcatacctagcacccagaaggtcctcagtagagacctattgaggtccagtaggctaactctctgcagggtagcaaagaatttgctctgagtttgttcctaactctgtaaggaatagtttaaactatctttaacaccaaagctgcatgaaaatggctgtctcagctgggcatggtggctcatgcctgtaatcccagcagtttggtagactgagacaggaggattgtttgaggccagaagttcgagaccagtttgggcaacgtagtaaggccccatctcttatttaaaaataaataaaatatttatttttttgagacggaattttgctcttgtcacccaggctggagtgcaatggcatgatctcggcccacggcaacctccacctcctgggttcaagcgattctcctgcctcagcctccccggtagctaagattacaggcgtgcatcaccacacctggctaaattttgtacttttagtagagacagggtttcaccatgttgcccaggctggtctcgaactgacctccagtaatccacccacctcagcctcccaaagtgctggggttacaggcgtgagccaaagcacccagcctaaaatgaaatcatttaaaaaaagaaaatggctgtctctttagaactatcaatttatccatttattgggtacagtctcttggggacatggaagtgctagaagtaatccaggagagctggctgtgaaaaagttcactgtgaggagacattgtacacatagcaatctggatgtgtctcagatgcagggctcagagtgatggaggccatactgaaaaggccacatgctgagtgacatatgtatttatgggacatcctggaagagacagactacagaaacagagatcagtgggtgctggggatcaggggggcaggggttgagtacaaaagtacactggggaaatttccagatgatggaaatattctgtttttttttttttttttgaaatggagtctcgctctgttgcccaggcaacctccgcctctcgggttcaagtgattctcctacctcaggctcccaagtagctgggactacaggcatgtgccaccatgcctggctaatttttgtatttttagtagagacaggtttcaccatgttgaccaggctggtctcaaactcctgacctccggtgatccacccgcctcagcctccaaagtgctgagattacaggtgtgagccattgcgcctggccgaagtattctgtatcttgatggcaatggtagttacccaactatggatttgttaagacttgcagagttctacattaaggaggtgtatgtacaccactcctcaatttttttatttttatttatttatttttttgagatgggtgcctcactctctcccaggctggagtgcaatggcacgatctcggctcactgcaacctctgcctcccaggttcaagcgattctcatgccttagcctcctgagtagctgagattacaggcacacaccaccatgcctggctaatttttgtatttttagtagagatgggggtttctccatgttggccagcctggtcttgaactcccgacctcaagtgatccgcccacctcagcctcccaaagtgctgagattacaggtgtgagccaccgcacctggccaccttaattttttttaatggggaaaaatatgtttgtaaaaaaagtcttgatgcacattttacaagaagaaagagacgctgtgagagccaaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatcca

SEQ ID NO: 14119 - DNA, 1298 bp, Homo sapiens
cagcctgtcccagtcatagctatatcccagcacccagaaccatgcctggcgcatagtagttgcctaataaatgtttgctggatgagtgagtgaacctctctgggccttattttcttcatcggaaaaatagtgataacaatggtaatagtaacaactactgcagtcaggatgatcatgtcaagctccaactcctcgatctggcctgcgatgccctgcatgctgctctcagtgtattcatacctcttcagctgcatttcacacggaggcccacggctctctgcactccagccacctaagccctgctccagtttctcaaactcatcagccccttatctcagggcctttgcaagtgctagatgcacttccttcccttacttcacctagttcatcaaatagctttttaaattttttttggagacagagtctctctgttgcctgggctagagtgcagtggcgcggtcttggctcactgctacctctgcctccctggttcaagtgattcttgtgcctcagcctcctgagtagctgcaattacaggtgcatgccaccatacccagctatttttgtatttttagtagagacggacttcaccacgttggccaggctggtctcgaactcctgacctcaagtgatctgcccgcctcggcctcccaaagtactgggattacaggcgtgagccatcgtaccccagttcctcaaatatcttacccgcattagcacttctttggagaagcttcctcagatctctagaccagactaaatcctcctgtcttaagcttttagagtgctgtgcgccttttctttccagctcttctcagaagtggtagctacagatttgttgatttacttttagtctaatgccagtgttctccagccttttgtcagctctgcaagatacagatgtggtttatttgctccaacatgtaaatgcagaacttagcccagtacctggcatggggtaggtgcatgatgcacgctgggactacacagacaaatggatggttgcctggcatggctcactgaggacactcaacaggtaccagcaccatttatttaagcggatcaactaacgaatgagttagagagtggctggaatggatgtatagcactaatttgtgagagaagacagaatgagaatgtaattccaaaacaatgagcaaacatcagaagaattgaagcaaataactgcaacatttccccagttgtccctctcattgttcttaaaataaaagcatttctgctacggagtcaggcaaataagtgaaaaagccacataaaggaagagcagtgactctcga

SEQ ID NO: 14120 - DNA, 1298 bp, Homo sapiens; identical to SEQ ID NO: 14119

SEQ ID NO: 14121 - DNA, 554 bp, Homo sapiens
cctcttgagataagccaataggtgtttgatgttcagtgttcagaaagccagcctgactgctctcagatgattaagcaagaggctatagtcggtggggtggcagggggttgggggggaacaggcctccccccttctgtttccagaaatctgacctctgcctcggccacattccccgactcctgggtgtgagataaggccgctgtctcctgttcccttctcttctgtctggcctggctgagctggcgtgtatggtcttagttttctatatttatagagacaaggatgggggaaccatggtagggggcagggggttgggggcggctggcccagagcttcagggcctgtggaagctgcctggccgcagggggtatttaactttctgcccgatggttgtaattctgggggcagccgaactggtgggatcaggtccctctggctgcgatgacaggccttcagcaggcactgtaattgcagcgttaaaacccctcattttcttcccggcaagctgtagttaagaggtgctatcgggcagccgggttgtctgcagggaggct

SEQ ID NO: 14122 - DNA, 26427 bp, Homo sapiens
tgtgtgtgtgtgttatcgggaaagatagctcatgagccttttaccctgcgtatgtacatggaagctgaggctgggagcagcctgtatttactagtaacattgtttcctaaagccccagcagagtaacatatcctccccctgccaagactcagtagctcacctctatctcttacagcatccagtcagaagtgtcctttgagggagcctatgggaacctcaagcggctgtatgacaaggcagccaaaatgtaccaccaactgaagaagtgtgagactcggaaactgtctcctggcaaaaagcggtgagtggggcctgtgaggaggacgggttttttctgcagttggtgcagtaggaccatagggactgcgggaccattcagcatttactttgggctcttctcatttcagatgtaaagacattaaaaggttgctagtgaactttatgtatctgcaaagcctcctacagcccaaaagcaggtgagtggaagagagcatgaacctgaactatcctgtgagccccagccatgatgctttacagaaggaaccttgacaagggtggactgtcgagttctgccctcagtttgaacatccgtaaccaattcatcctttcttggcattcctcactgtttctcccaagggtcctatgcccatcctcctcccagcagctctccctatggcacagaatgggtgcttaggagatgttgaagagggaatggctgaatgggaagcctactcacatcccttcccctgttttagttgctatggagatcaatccagcactacccttccctggtgtgctctcaggtctcccctgcagcatcccatagtcctttctctgaatcttgtattccctgctcttctccttccccagcccccaccactgacctcccctgttactcctgcccctctgtagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggtaaccttccctatgttcctcttttctcttccactggctttggggatcctcactccccttttctgcagctccttattcataaacttccttccacaagcagcctcttcactcctgtgtcactgcttggctgtgggcaagtaagggccaagggatcctaccctaaaggaggtcctggtaattgagtacaagcaacagcacatttccttcccccttctccttactgcctcccataaatatgcacacccttggccagggcctgtgcagacacaagggtcagggtacttagtgatcatccagacagaatttcagaccttctgttggaggcatttaggcaattctggaagcctttctggcagaagtgtatgtagagcaagattgggaggtaaggagggataggactggatgtgaaggctcttgaggcatggggaggaacctcagagccagggaggatgagatgggacaaaaggatatgcttatctgaaggagtacaaggtgagatggtaaattctagattatggaagggataataggacacgtacagtgcctcacgcctgtaatcccagcactttgggaggccgaggcgggcagattgagcccaggagttcaagacccagcctgggcaacatagtgagactcttgtctctaaaaagttaaaaaaaaaaaaaaaagaatctttgataagtagttggatccttggaagagttgagaacagatgagatgtggttggaattgatggtgcctactcctcatcagggccctaggcccctaatgcctggctttcctgacttcaggatccaagcagtacagtgcagccattgccttcaccctggccctcttttcccacctcgtcaatcatgtcaacatacggctgcaggctgagctggaagagggcgagaatcccgtcccggcattccagagtgatggcacaggtgggagaatcggggaggtcatcactatggaaaggttggtgtggggcatggggatgaaggaaaggaacacagactcgggggaagtggtgttggagagcacattccagcttccaggctccacctgttcctcgggctccacctgaccttcctctttccgcagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccaggtatttggaccacttcatcatcctgttctggtccgcacctccatgccatagacactcaccagagaggccgctttcctatctgtgtgaatgacctctcgtctctacccttacctttggccctctgcctgtggtgtagcccatgagttttttcctgagggtccaccctcctgctcacttccttattcccatctcccaacccatttgttggttttatttcttttgcacttcaccctgtcctgtgggtttggggctttcctccctacacaacaattgcagctgcagcttccttccctgtgccatcccaagtccctccagggcttctggaagctagaaaaactggtacccaccagcgcaggtgcattagagtgagacttctctcctgaggatattccctgcaaacagagtacccatttagtagcagcaaccgtttgttaaggctactctatgcatcattctagggtgttgtcttatttaaccttcatagcagtcttgtggtagaagagttgtcatccctactctaggctgtcttttacttccaaagttttttttttttttttaaagacagggtcttacctatcccccagactggagtgcagtggcgccatcttggctcactgcaaccaactgcttcccaggctcaaacgattctcttacctcagccttctgagtagctgggatgacaggcatgcactaccatgcccggcttttgtgtgtgtgtgtgtgtgtgtgtgtgtgtgtgtgtgtattttttttttgagacagagtctcactctgttgcccaggctggagggcagtggcacgatctcggctcactgcagcttctgcctcccaggttgaagtgattcttctgcctcagcctcccaagtagctgggactagaggcacgcaccaccatgcccggctaatttttgtatttttagtagagacggggtttcgccatgttggccaggctggtctcaaactcctgaccttaggtgatcttcctaccttggcctcccaaagtgctgggattacaggtgtgagccgccacacctagcccctccaaacttttatacatagtgttttgtctgtctggcaagtgcttttcctcccttgctcccagcctgtcacttagctaattcttacttgcccccactagattttagcttaaaagtcacttggtctgggactccttcaagggtatgttagatttgcttcttgtggcctcctgcacctctgcagcctccagtccttttccactctattgaggttgactgttgatttgtctgtctccccagttagagtctgaactgcttgagggcaggacagaatatttcttacttattgctgtatccctagtacctaacacagtgtctggcacatggatgggacttaagaactatcgaatgactgagtgaatggcagaaatgagggatgctcagagatgtgaagggacctgtccagtgttctcacttgcaaagtagaagaggtaggaattaaaagtaactcttttttttttttttttttttttttttgagacggagtctcgctctgttgcccaggctggagtgcagtggtgcaatctcggctcactgcaacctccacctcccgggttcaagcaattctcctgcctcagcctcccgagtagctgagattacaggcatgcaccaccacacccagctaatttttgtatttttagtagagacagggtttcaccatgttggccaggctggtcttgaactcctaaccttgtgatccgcccacctcagcctcccaaagtgcagggattacaggcgtgagccaccacgcccggcctgaaagtaactcttttaaaaccataccccttgcttttctccctcccttatagctcccctctaactgtctgccctgccttccagcacagagtaggcatttcataaatcctagttgaatgaatagctgtagatcaacgtcacaaattacttgagtctataagaatcatatttaaaaggcaccatattttaaaaacaaccttggtaaaatgaatttgatgagattaaaaaacaacaacagttagtgggcctggaaaaattgaataagggcctgtaagtggttccccagatttttcatatccaaattccttggaagggcccaggccaggtggaagcatgctccctgcacagagctgaggcctgttcccaagtgtcagttgtttatcccagtttttttctcttccattcacccaccccccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcaggtgtgtcagtccactccattgcccctgtcaggtcccagggtcttggaggaggggatgagccaggatggggcctgaggatcccccctgatggccaaggcaagaattattgccaagcaattaatcacctatctgtgctgggcccttatgctctgacagggaaggattaggcatgatcttggccctcacaaagcctgtggccagggaacaattagcgagctgcttattttgctttgtatccccaatgctgggcataatgcctgccattatgagtaatgccggtagaagtatgtgttcaaggaccaaagttgataaataccaaagaatccagagaagggagagaacattgagtagaggatagtgacagaagagatgggaacttctgacaagagttgtgaagatgtactaggcagggggaacagcttaaggagagtcacacaggaccgagctcttgtcaagccggctgccatggaggctgggtggggccatggtagctttcccttccttctcaggttcagagtgtcagccttgaacttctaattcccagaggcatttattcaatgttttcttctaggggcatacctgccctgctgtggaagactttcttccctgtgggtcgccccagtccccagatgagacggtttgggtcagggccaggtgcaccgttgggtgtgtgcttatgtctgatgacagttagttactcagtcattagtcattgagggaggtgtggtaaagatggagatgctgggtcacatccctagagaggtgttccagtatgggcacatgggagggctggaaggataggttactgctagacgtagagaagccacatcctttaacaccctggcttttcccactgccaagatccagaaagtccttgtggtttcgctgctttctcctttttttttttttttttttttctgagatggagtctggctctgtcgcccaggctggagtgcagtggcacgatttcggctcactgcaagttccgcctcctaggttcataccattctcccacctcagcctcccgagtagctgggactacaggcgccaccacacccagctaattttttgtatttttagtagagacggcgtttcaccatgttagccaggatggtcttgatccgcctgcctcagcctcccaaagtgctgggattacaggcgtgagccaccgcgcccggcctgctttcttctttcatgaagcattcagctggtgaaaaagctcagccaggctggtctggaactcttgacctcaagtgatctgcctgcctcagcctcccaaagtgctgagattacaggcatgagccagtccgaatgtggctttttttgttttgttttgaaacaaggtctcactgttgcccaggctgcagtgcagtggcatacctcagctccactgcagcctcgacctcctgggctcaagcaatcctcccaactgagcctccccagtagctggggctacaagcgcatgccaccacgcctggctatttttttttttttttttttttttgagaaggagtttcattcttgttgcccaggctggagtgcaatggcacagtctcagctcactgcagcctccgcctcctgggttcaagcgattctcctgcctcagcctcccgagtagctgggattataggcacctgccaccatgcctggctaatttttttgtatttttagtagggatggggtttcaccatgttggccaagctggtctccaactcctgacctcaggtgatccgcctaccttggccttccaaagtgctgggattataggcatgaaccaccgtgcccagccagcccagctaatttttgtgttttttgtagagacaaggttttgccttgttgtccaggcttcttttgttaattttaaaatcaaacccccacaggcctctgaacataggccagatccctcagggtggtgctttccttgctcactgctgttctccaccactgtctctagctgaaggcctcctctcccttctctctccccagagctctcaaagtctgtggaaccgcctgtctgtgttgctgaatctgttgcctgctgctggtgaactccaggagtctggtgagtgggtccctggcactaccctcctttctttgctctctcattgtccccactaagcccatctcccctccccataacccagcccttggggtaaggaggttaatgggattcactgccagcctccctagcacacagcagtcattgtgtggtctaggcctctccggtttcccaccacaacactgctgtattgtgggcaggtggcctggtcagcaagggagtgtgctccctagggaatgcaagggcagagtgagagggccctgggagccagacctagctgctgctgttgcactgatgcctgtggtcattgagaattgactttgacctaccaagtttgtttgtctggctcatctcctaccaccttccagctggaaaactccacctgctcctacctgctaagacttgccaagggctattcattcatcctgagcgcctcctctcatttccatcccaatgtaattgtccctgctgtcaggaagccttcctgacctgagccatccttgttcttcctgagcccctctgctctgcctgactggctcttatgtgtccatctctctttacttcactccctccatctctccgcactgtcctagggtatgtcctgcctcatcatctcatcagcctgataattcccaaagggaagggttatgtctctctgactgggagttcccacaggacagatggtcttatgtgtccttcttctgcccaggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggaggtaaggatagcatttcttatgccacagctctgtttgtcagtcacaaacagcagcaaatgggttcagatctggggagggagggggcaggatgccctcttccactcagacagggacagtgtccttggggctacaggctgtgcttccttcttcattcagtgagccattttagcttttttcctgccttggcagtccttctaaaggtctgccattggtagtttctactattgtagaacaaccacccccttcctttctctgccttctgtaaagggcagaacaaatagttattagggcttcgaaatctttatcagtctcttttctaactctgggcccagcctgctccgagctgaacatcaaacaatcatagaaagttagagctggaagggaatgtgctgcccgcttagtccagcagctttcacccttaaatctccatcaccacatgggccatctgggggcagcagagggaagtcaagcagacaggccacccagtcctgacatacataaaccacctggctgctccctccaaccagagctgcttggctctgttttatattttagagttctagataagatttttatttgagagggaagaagggttttactgaccacaaaaataagttggggccaggtgcaatggctcacctttgtaatcccagcacttggttgggggccaaggcaggtggatcgcttgagctcaggagtttaagaacagcctgggcaatatggcaggaccccatttctatcaaaaaatacaaaaattagctgggcatggtggtgcgcacctgtagtcccagctacttgggggccgaggcaggaggatgacttcagcccaggaggtagaggctgcagtgagctgtaatcacaccactgcactccagactgggtaacaaagcgagattctgtctcaaaaaaataatacattggaaaatgtgatctagtttggtcccctagagcatatgagaagcattaggagagagatggtattagaacccaggtctcctcacttccagcccagtgtcctttgctcttgtttcttagcccaagtcctggttttctggtcctcctaggagttttcttgctgtacctactcgttttctggcagttagaggctctgggccttagtgtttctccttcccaccccatagaccacaaatcttcccctggagcccttgttggctgaggtggctgggccagcagggaggtgggagggtgggagtggagggtcctggagggcagggtgggtctagagggccctgctcagcagcgctgggctcctgtatctccccacagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggtgagtcaggccttcccctccccgtcagctctgctcccattgggctcactgagaaaccagggcaagaggctcagaccctctggtggtctccacctgaaggacatagtaagatgcctagggagaggggaggggaggctgggagggaggcctgggaaggactaagggatgtgactgatagacagggactgagaggggttttttttttttttatgagatggagtcccactctgttgccaggctggagcaagtgacgtgatctcagctcactgcaacctccggctcccaggttcaagtgattctcctgcctcagcctcctgagtagctgggactacaggcgcacgccaccacgcccagctaatttttgtatttttagtagagacagggtttcaccatgtaggccaggatggtctcgatctcttgcccttgtgatccacctgccttggcctcccaaagtactgggattacaggcatgagccaccacgcctggcctgaaaggggctttgagcagaggctgcctagctcaagacctgtacccagactgacctggggttgaggccatctctgtcaccttttaatctatgaattgagcaagtcacttaacctcaccacgccagtttccttgtcagttatgtgggaacaaacagaatccactttatggagttttttgaagatggaatgatagtgggtgtgaggtgccttgcacattgtcttatggcacatgtgtgtgcctagcaaatgctccctctgttccctttcattcaagagggataaagactgaggaatagaagggagcggagggctcctgatataaggggccatgaaggaaccttcccatcccagacatggtcccatcccacaggggccccaaaggatggaaagtggcctgtggtacctcttttccatccagtaattcattccacgaatatttatcgagagtccattttgtgccagacatgacagtattctaggcactggggttatagcagtgaacaagacagtcctttctcttgtgggcaacaatctggttttcacagtggggcctgcacagccttgggcatgtttcccaacacaccaccctgagctaagtggcaccagaacattggggtgttagtgtctggcacaggaagtatgatgtgtctcagcaacccctcagggtttcttcttcatctcaagccaatcccctcctccacattcttcctttgcacctgtcccagggccagtagcttccacaccctgtctgagtgccatttcttgtgggcattctgcttggctggaaaggggcaaaagctccccagaaactcccttccttactgtctgaaaaacaagcacattttgttaaaaacaaacctttgttaaggcttttattgctagtccataggggaagacatggggagggggttacaaaaataattatggggaagttagcttcaaaaaatgttaggagtttttgcaggcatttcctctagcctaaagctcttgaagacactcttcctgtcggggggtagggagtacctgcaagcccttctcatgtggtgctagactccacatgccaagatagacacaggccacgttgcttgctggggctgcctcctctgcttgagtcacaggcttccaccccgaagggcttatccccagcccagaggagtgttgtcgttatcacatttatcaagagttttctctgtgcacagcctggtttgcatgtgacatctcaattaacccttgcagcagcccagtgaggtaggtgcttgcatcctccattttatagataagaaacagtaggctgggctctgtggctcacgcctataatctcagcactttgggaggccaaggcgggcggatcacttgaagtcaggagttcgagaccagcctggccaacatggtgaaacctcgtctctactaaaaatacaaaaaatagccgggcatggtggcaggtgcctgtagtcccagctacttgggaggctaaggcagaataatcacttgaacctgggaggcagatgttgcagtgagtcaagatcgtgccactgcactccagcctcagcgacagagcgagactctgtctggaaaaaaaaaaaaaaaaggaaaagaaaagaaaatgtagaaagacaaaggaacattcccaagatcagaaagtatagtcggtggtagagccagggctctggagttggacacactatggatttcttatcctggctcttttctgctgctttagagacttagcttctctgtaggccaagtgggcactaggagttgcggggggtgtagtacctgctgatgggacttctgaaggtaggctttccctctgaggaacgcgtaggcctacatctgtttgaaatgctgggttggtaatgtcagagcctcatattagcacagctccatcttcttgggtccaggcggatctcactcacctacactagttctctgggggagcttttacacaagtgcccccatccccctctcttgaatatggagtttcacaattaccattttagtctaaaagcaactcattggcttgatttctgcagtgggaagagggaaagtttgtctatggtgcctcccttgcttaccagtttgcccacagggcctgtgagaaaatggctgttaggttgaggctgcagtgagccaagatcttgccgctgccctccaacctgggtgacagtgaaaccctgcctcaaaaaaaaaaaaaaaaaaaaaaaagagagaagatggctctcacctaggctctggccttctgcttccattctttcatttgtttacattgtttctcaaggggacactcttggcaccttgggcaggacaattctttgttgtgcaggactctgcaggggggtgggagtggatcttgcaactatagatgttattcctctttccctagtcttcccactaatgtctgttttctctttgtaatccagtccaggacccacagtatgtttgactgtcatgtatccttagtctcatgcaatctctgacagttctcagtttttccttttctttcctgatgtgacactttcgaagagtactggtcagttatttcatagtgtccctcaatttgggtttgtgtgatgtggtctcatgatgagaatgagaattttttttctttttttgagacagggtcttgctctgttgacccaggctgaagtgcagtggcatgaccatagctcactgcagccttgaactcctggcctcaagcaattgtcctgcctcggcctcctgagtagctaggactacaggcatgcatcaccaagcttgactgatttttaaaataaaaaaaatatacttttttttgtagaaatgtgatcttgctatgttgctgaggctggtcccaaactccagaactcaagcagtcctcctgcctcggcctcccatattgctgggattacaggcatgagctactgtgcctggccccaagattaatattttatttaatttttatttttatttttgtatatttatttattcattttctttgagacggagttttgctcttgttgtgcagactggagtgcaatggtgtgatcttggctcaccacaatctctgcctcccgggttcaagcgattctcctgcctcagcctcccgagtagctgggattacaggtgctcgccaccacgactggctaatttttatatttttagtagagacggggtttcaccatgttgctcaggctggtctcgaactcctgacctcgtgatctacccgcctcagcctcccaaagtgctgggattacaggcatgagccactgtgtctggccccagtttttgtatttttagtagaggcagggtttcaccatgttggccaggctggtctcgaactcctgacctcggtctcccaaaatgctgggattacaggcgtgaaccactgtgcctggccccaagattaatattttattttattttattttattttgtttatttattttgagacggagtcttgctctgtcacccaggctgtagtacagtggctctatctcggctcactgcaacctttgctgtccaggttcaagcagttttccctgcctcagcctcccaagtagctgggattataggtgcccgtgaccacacccagctaatttttttatttttagtagagatggggttttgccatgttggccaggctgctctcgaactcctgaccttaggtgatccgcctgccttagcctcccaaagtgctgggattacaggtgtgagccaccgtgcctggccaagattaatattttaaagcaccactttgatgatgccactttggtcatcaaagagtcttcagtgggctgggcgctgtggctcgcaccagtaatcccagcactttgggaggccaaggcgggcagattgcttgagcctcaggagtttgagaccagcctgggcaatatggtgaaacccagtctctacaaaaaataccaaaattagccaggcatggtggcatgtgcctgtagtcccagctagttggggggctgaggcaggaggatcatttgagcccgggaggcagaggtagcagtgaacaggaattgtggcactgcactccagcctgagtgacatagtgagaccctgtctcaaaagaaaagaaaaacataataaaaagagtcttcagtggctccccatatcttacaggataaagtccccatccttagcctcatcttatagaccatactaaggaatttgggctttacccataatacagaggaaaggcatcagaaaacttttaagcagggctataatgggcatcagatggtttttaaaagattgccttggttgtaggtggagaagagggattgaattagaggcagagaccagtacggtggttgttacagtagtcaaggagaggtgttggcttagactagggtttcacagtggaggtggaaggatttgcatgctgtttaggggggcacaattgacaggacagggaacctgataacttctggggctgagagaaagggaagattcaaagccaaccctgagctttctgacttgggcagactggtttatttactaggctagggaacactagaggaagagacgcaggttctgaggagcagatggggctgctgagtaggcagttgtatgtgtgggtctggagctcaggatggtcaggcctgggctgaatctgcagatttggaagattttggcaagtggatgggggtagaaggtgaggaagtgcatgggtaggatctcctgggaagggagaccagattgagaagagcagagattgaatcctgaggcacagccaggtgatgtcctgcatggtgacggcacatggctgtctgcttcccctcccctgcagggcctggaacatcatgacctgcatcgggttggtaatggaagttgttcagagtgcagtggaagaatattttttcttccatgcctctcctcccctcattcagcagcagtgctagagagtgactttgcatgaggtcacactgagaccccaggaaaccctcttggtcttcctgatcactggagaagggaaaatacaccccaactccttacagctcattttttccctcataggcacaggaggaagctcgtcggaacaggctcatgagagacatggctcagctacgacttcaggtaggaaatcaggacccaagtgcttcttctgcacttggtagagcttttgtgtcaaccctactggcaggtctcccccttccgctgtagtccccctgctctgttgcctctgtgtccctccgcctctcccagatgaccctccttactactcactcttcactcagccatttgcctcctttctgccttcatttctgtctctccctctttaactcttatttctgtttacttttcccccaaagccattggtagagagggtcctctgatccccttaacaacaggaggagccccatagagccaccttgagcaccactcttcccccggcccggctgcaggggtcccccacagctgtacccaccttgccctctctcaccagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacaggtaagtacattggagaggtaaggagacagagtatgactaaaagagattctgggcttgggattaagagaccttatttggggcccagtttatatgcagtaaccttggtcaagtcttactacctttgtgaacccgtcacttcatctgtgaaatggacataatccctattctgccttacaagacagttgggagaaacagaaaatgtaagtgaatataatgagaaagcacttggtaaattgccaagtatattgctggcagaaggtcatgttttcagagaactttgggagccctctagggagccagggtcccttctctgcctgaagagtgtactgaggtgagctcagatacttcctccagagccccttgtcacagcagtctgagcttatctgttttgtctttccctaccttgcccaccagtgatcgatggcctggatttgctgaagaaggaacacccaggggcccgggatgggattcggtacctggaggcagagtttaaaaaaggaaacaggtgagtgtggcctggctggacctgtgctgagccctgggtctgtcttttggataacacatgcttatgaaagccccttgctccctatgggtaagacacatacatacccgtctctactcacagttagctcacctcactgcctggggagtgataccagagataattagaagtcaaggttgtagctgctgaaatagagggtgaccaaagggatcaggagccctgtggggagcactgagctgctgtccttcctctggggcaagcctgtgatcagcacccactggggagaagggagcagacctccctcccccaactttagactgtgaactcctttataggaatttctcctgctttggggttgggacaggtgatcaggtttctcagagtgtgagggcctcatccaggctgcccaggggcttcccacctccctgctgagctgagggagtggtaagaccgaagccagccagggaggggcagctggcagcatgtgcagatgctcagccggtacaggcctgcccttctggcctttggggctggaggagaactaggcagagggtgtagggaataaggagaaagcttccctctccctgctagctggcccaccccctcctctgcatctgctctggctggccaggaagctgcacaaggtctgattgttcggaccttgtctccagaagccctgacttgaaaagcatctgctgcttctcccctcccagctcctcccctgagaggaaccaaataattgatgttatcaggaggaaaagtgagctgggcccagcagccaggaagccacttaagaatggctccagagctgtggtgggagagacatgttccccagccccgcctgcaaaaccaggcccccagagccacaacagactgctttgtgtaaggcaccctgccagtctcctgctcctgacctccactcgcacatctcctctgcaggtacattcgctgccagaaagaggtgggaaagagctttgagcggcataagctgaagaggcaggatgcagatgcctggtaacattttagccctcacccctagaacctcaggccacctgccttgctcctccacgagcattcctagggagaacgggtagggctggataattctgaggctccacacgtagcctgccagggccctcctgcaggcctcaccttgcgaggagtacgaagttgccgcagcacctgagcttttcctctgcagatgggtcagcctctttgggccttgcgatgctcaggcttggtgttttccctcaatgcacctttgcctgctccccatatgtctccagggccagcttccagggcccactgctgctcactgccctcccagcccccagctgcccctgtcccctggagatcctggtgtttgggctgtgctaatgctgggtcttggcccatcttcccctctgccccccatccccaggactctctataagatcctagacagctgcaaacagctgactctggcccagggggcaggtgaggaggatccgagtggcatggtgaccatcatcacaggccttccactggacaaccccagcgtgctttcaggccccatgcaggtgggtcatgggtgaggtggggggatggtgtggaatagggacgaggtaccagagcagactccatccccagaccctccacatagctacctttttttctcttccatcactccttccccagcgcctcaacaatttgctcttcagttcaggaggtcagaccctctccatctttccttctcccattccacaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaatccctgtctcctggtgcctgtctgtacagaagtttcattggggggtggggcactgaagatggcatcctgaaatgcattttggaaaggcttctttgaagtggatggaacagaacaagaagcaggcaatttgagtgaaggccctggagatggtttgataggcactgtcaagttccttgactgtaaactgaggcggtgcctttgcaggggtgatagtgaaaatctcttgccagcaacatcgctgcctggggttggttcgctgtcactagctgggtcctcttccccaagggggtggggaggtgagccttgaaaccagcctctggccaggcgtagtggctcacgcctgtaatcccagcactgggaggctgaggcgggtggatcacaaggtcagatcgagaccatcctggctaacacggtgaaaccccatctctactaaaaatacaaaaaaaaattagctgggcatggtggcgggtgcctgtagtcccagctactcgggaggctgaggcaggagaatggcgtgaacccgggaggcgaagcttgcagtgagccaatatcgcgccactgcactccagcttgggtgacagagcgagactccaccttaaaaaaaaaaaaaaaaaaaccagcctctgagtcctcaagtgcctgtcctgcaaggattggcatctcaaattgtattcggggggggggggggggggagggggaggtggtgagcctggtgaatcccccatgatagaaccaacatttaccaaaggcagtttgctctgagccctaggcagcaccaggtgctaagaggcagcaaagcatggtgagagatggcttctgaaatctgttctgcatttggggatttgggttcctctgccagcctaaggcagagctgtccccaactgctgggagaacctggaacgggaacactgctctgagtcgccggggggactctacagcaccatggccacatcctgccttgggcccctaccctgttctagccagtcagcacagggagtttgggtcgtgctggaggagctggctgtgtgcaggcggccgagtgagctgcctgctaatggggctgggccaccccgtgctgctccctggaggctggacaaggctgggattgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtaaagcatcttgctccagccacccctcccccatttccatagcaactgcacacactccactccagagatctccaaaccctactactaagggaaggcaccgtgagggcagctagaccccagcgtattcctcactcctcccccagatagatgggcagcactcagggtaggggagacccccgaccatcccacttgtgggagcgagcaagggataccctgggaggccctcatccatctttgttctgctggggtgcagggactagggccaggtttgcctttgcccagcagggtctccagcacccatctcgggcagaggctgggggagtgactgctggtgcaagccccaaagtgcatgcggcaaaaacatggatgcagagctggtggcaagaagaggggctaagttatagagttgctgcaaagttttggcctggggaggtggggggagtgtcctagtcctcctcctggggcggctccgcctgcccagctggcccagcccctccacttgtgccaaggaatgtgccgggagaggcgggcggggcagcagagctgcggccacccggaggcagtgcacaggtctggggctgagggatacctgggctcaggaggggcagggaccccaaaattctcctgggggcacaagtgtagtcctcagagaaaagccaggcatccccctacctccttgtcccacctgatggcatctggcttctccagagattcggagtgccaagagtgttctgtgctcagttcaggcgctgtgggcgaagcacattctggtgggaaagggagtggtactcaggctgtctctgtgctggcctccaggagtcaggattcttcctgagacaaaaactggggcctgcggggctggatcactatttgaggcagcctcccggctgggaggaccccgccactctttgctgggctgaggccgccaagcccctcagtgtggggactgaatgccccaaggagaacaggggttggagttaagtggtgcaagggctggggaaggtggaccagcttccccaggcctgaaggaagcagctccaggagggagggtgccatctgcctcccacacgcacagcccatcctgcggctgaacccaggtgaaaggggcctgtggatgggggcagttatctgatcccctacctcccactctgtctctaggtcaacgtggaggtaccaggccaccatgctcagtctcaagctgccccaacttcttcaagtccaccaggtcccccgggtgaggggctccacccactgacccaccaacccccattccctagaggactgactaggggctgacgttcttctcttttagctattggggcagcccctcctgcaggcgaactcttaccctcccattccagtgtgagactcttcctctgttctctgaggaacaagcttgtggccctccatctggagtccccttccccagagcgccctgtgtgctgcgctccacccccatcccaccccaatctggctcttcggtttcctatttgttttgtgggttgtgggtactgggacctgtggtaacatcagatcagatttagtttggcttgggggccacgttgatctccagcccagcctctttgaccctgcttccagagatctcagatggagggaaagggtccgggcacagtgacgcccttcctctcccaccactaccctaggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggtgagccggacaggcgcgggagcgcggggtctgggcgtcccggagcggggcgaggggtgggacgcgggacataggggcgcgcccctcaggcctcagctgcacgcccccacctcaccgcaggctgcgccttcccctatgccgcctactccatgccggcctcctggctgcacggccacctgcaccagttctttgtgcctgccgccgcactcaactccttcctgtgcaccggcctctcctgctactcccggtgggttcccaggcccctccagtggggacggggaaggcggaggcacaggagaggacacacctcactgctctcgaacagcactggaggcatcgggaccatgtactgaggacttcctctgtcagaccctttatccccacatacagatgtggtcctttacacaggaggtcatatgccctaacggttttcttagctgcaggctgtgctgatattccatctttgcccaagtcctcttgcctttctctgacccctaccccaagcacagcgatggtgaccggccttttcctcccgcctcccagtttcctggagctggaaagccctgggctcagtaaggtcctccgcacaggagccttcgcctatccattcctgttcgacaacctcccactcttttatcgggtaaggaggcctagggcccctgcccagactcctgctttcctgtcctgaccctcaaggtgcccacttccagccctgccccctcagtccctgcctcagcccagccgcctctcttggggtccagcaccccgcctagctgtgcccgcccgctctgcgtcctcaccagatcccagacacaccccatgtttcggctcccgagtccctccccagcagccttggttttcctttgacagctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggtaaatgggtattacagccccaggatggaggcaaattataggagggacttccctgtcttcctataacgagagcatcactggaagggtcctccacctgccacttctcaggtagcaaaactagtagcatgtgtgctggggccacatgcacacatgctcattcattcctttcagtcactctgggagtcagggtttcttattctcaatttatgggggagtagcaggcccagaggatggggtgacttgcactgggaaaggtgtggctctgacctgcccatcctctccacaggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccacagattcctcttctggagtttatttgggagcagctgggatgatggggaccccacatccatagggctgggaggtcagggcaagggcaaggggaagaggaaagaagggtgcctggagaggagcagaactggggttgccggccaggccagcagagcgacaccctagaccgggccgtagaagcgccgataggcctcctgaaagccgatgtggtcagccaactcgtcacagtccggattgagctcacacacctccctcctgggctccaggggatccgggtaggggactggggctctgagacacccgacgtggtggcatcagcccccgtgcaaaatgcccatccctcctctccctacacatggggctccagggtgcccaccagggcaggctgcctgtacccccaccacaacccagagaggccactccctgctgcagctcccccacagaccatcccggagaggcagggccttggcccagctctgccttttctctcaccccagccattgatacaggtagcgcctgggtctcttcactacctcgctgccctcctgcttggacacaaaggctgtggagcagaggggcaggcatcaggtggctctgggtttgggaggatcaggtggggagcaggctggccttcctgatggccagacaggaggtggcaggagtgggggaatgagactgagggaccagggtgagaggggagggtccaggaacccatcaggtccatcctcatacctgcacctttgctggactctgcaccgctgggcttcgcacctgcaaaggaaagggagcctggttcaccccagctcatccccagggccctcatcctccttcccctgcgtctcgggcagcttgctcttccctcctctccctctgcaagggcagagctggggcaaatggattgagcctgcaacaaggtggttagactgcaaagggactgccagccaaaggggtgagaagaggtgggccatggtgcttcctcctctcagcccccactgcaatgcggcctgaggggaggtgggggcactcacctgcctggccagcgatgcaaagtgcggccagggccaatagggcgaggagtgtgagggctctcatggtgtctcggtggctgcgctgggctgctgctcaggactcagctggcctgccccgccagcctccagcac

SEQ ID NO: 14123 - DNA, 26427 bp, Homo sapiens; identical to SEQ ID NO: 14122

SEQ ID NO: 14124 - DNA, 104 bp, Homo sapiens
ccagcactttgggaggctgaggcaggtgaatcacctgaggtcaggagtttgagaccagtctggccaacatggtgaaaccccgtctctactaaaaatacaaaaat

SEQ ID NO: 14125 - DNA, 447 bp, Homo sapiens
ttttgagatggagtttcactcttgttgcccaggctggagtacagtggcgcaatcttggctgactgcaacctccgcctcccgggttcaagtgattctcctgcctcagcctcccgagtagctgggattacaggcacatgccaccatgcctggctaattttgtatttttagtagagacaggatttcaccatgttggccaggctggtctcgaactcctgacctcaggtgattcacccgcctcggcctcccaaagtgctgggatttcaagcatgagccactgcacccggccgtaatgattcttggagggtgccaagagtgacatctccttggcagctcatcctatccacagggaacccaggggtcctggtttttgtacaaggggctctgctgctctctgcacatgatggtctagtaagccccttgccaaaccaccccagcctggatgctccc

SEQ ID NO: 14126 - DNA, 111 bp, Homo sapiens
agacggagtctcgctctgtcgcccaggcaggagtgcaatggtgcgatctcggctcactgcaacctctgcctcccaggttcaagtgattctcctgcctcagcctcttgagta

SEQ ID NO: 14127 - DNA, 134 bp, Homo sapiens
tgcctcagcctcccaagtagctgggacaacaggcgcctgccaacacgcccggctaattttttgtatttttagtagagacggggtctcactgtgttagccaggatggtctcgatctcctgacctcgtgatccacc

SEQ ID NO: 14128 - DNA, 26427 bp, Homo sapiens; identical to SEQ ID NO: 14122

SEQ ID NO: 14129 - DNA, 26427 bp, Homo sapiens; identical to SEQ ID NO: 14122

SEQ ID NO: 14130 - DNA, 104 bp, Homo sapiens; identical to SEQ ID NO: 14124

SEQ ID NO: 14131 - DNA, 447 bp, Homo sapiens; identical to SEQ ID NO: 14125

SEQ ID NO: 14132 - DNA, 111 bp, Homo sapiens; identical to SEQ ID NO: 14126

SEQ ID NO: 14133 - DNA, 134 bp, Homo sapiens; identical to SEQ ID NO: 14127

SEQ ID NO: 14134 - DNA, 26427 bp, Homo sapiens; identical to SEQ ID NO: 14122

SEQ ID NO: 14135 - DNA, 26427 bp, Homo sapiens; identical to SEQ ID NO: 14122

SEQ ID NO: 14136 - DNA, 104 bp, Homo sapiens; identical to SEQ ID NO: 14124

SEQ ID NO: 14137 - DNA, 447 bp, Homo sapiens; identical to SEQ ID NO: 14125

SEQ ID NO: 14138 - DNA, 111 bp, Homo sapiens; identical to SEQ ID NO: 14126

SEQ ID NO: 14139 - DNA, 134 bp, Homo sapiens; identical to SEQ ID NO: 14127

SEQ ID NO: 14140 - DNA, 15987 bp, Homo sapiens
cttcacaaaagtggactcatacgatatctgtagttttgcgtctggcttctctatttaattcttaaaggggggtgggaactaaacagatcacaagggagctgcccacagaggtaaagacaaggtcagataggctgagagacgcaggaaagcgggtcaatgtgtagggctggagggcaggggcgggccctgggcctgggctgggggtcctgccccggggcgcacccagggcgagggctgcccggaggagccgaggctggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggtccaccaggacagcgctccgggtcgacggggtcctggagccgcgctcggggagggcgcagcggagggtgagcggcggcgttaggacccggaggcgcgggcggaggtggcggggctaggacccagcggctccggcagagcggaagcggcggcgggagcttccgggagggcggctcgcgggtgaggaggcgtccggggccgcgggaagtagggtcgtgggggcctggcggggcgaagtaggggacccggaggggctggagggaggcgggcgggaggcccgggaccgttcctgaccgagaagcctgcgccaagctggtgttccgcggccgctgcccggtgcccggctccactgcgaacgccgccgctgggccccgaccgcccgggaggcgtcttgggctcgccccggagcttcctccctggagccgcgccctgcacccggccttgcccggccctagcagggaagccaaggcttgtggggcgcagggacccgggctctgcggggtcccggttccgcctccccactcctgcgtcttcccgccccggccgggttctgggaagcctcgcgcggctcttccgcagctgctgcccgcccggatctcctggtccctcgtaggggaccccacttctctgacaccgcgttgggttcccggggcctacagcgaggcctgtaactccgggagagaccctggagcggggtgtgggagaacggtctggaggaagggctccgagcacttcgaaagtataaaccgcggtcccaaagaggcgtgctgtgtctgcattttcctgggagtgcacggtttacattctgtaaagcagtgctgtcgactagaaattttgtgcgatacacatgtacaagttttgtcacttaaaaagaatttgaaaaaacttcatagatgcaaaaaaaaaaacccaccattattaaagaatacttaggcatttgtggaatgcattgaagagttaacaaaatggataggcaggaaatatcgcagacctagagtgaattacagttacccactgtggaactgaggagctagggtttctcataaaactccctgataggagacgacttttgataaaaatttttttccgccaacaaaatcccctgtcttctccactagttattgtctgtccactaaataagaggtggtccgtcacttcttcagatgagcaactacaggcttttcaaaagataattgctaatcaacccctttgtgcctgggttttcttatttgtaaaaatagatactactacctaactccaaagtgtgtggtgaagacaaacaactggggtgatgtatactaaagtaacgaaagtgttgaccacacactacgggctggttagtgttagattcccttgtttttccctcagtatcaaaaacagatctaatttaggtttacataaagacaaagtatgaagataaggtgacttacagttggtactactaacaaaatgggctaagatttgcattattgcatgaaaacaacaaaacatatcaataaataacaaaaagcttggaattcagacaacagatcaagtctgggcttgatctcaagctagtgttttgatgttgaaaaaatgttatttggtctttctaaccccatttccttatgtaaaattggggatgataaattcactgataataagagttaaatgagattcttgaggactcagaatggttctaacgtgtaagtattagcagtcatactgtagcataagaaaataccgtctgctgaaagaggaacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaagaaaaagaaaagaaatatttaagtcacatatgtgatttctaaaagtaaaaagaaacagatgaaattagtaatatatttttaaaatccagtatatcccaagtatggttattttagcatgtaatcaatataaaataataagatattttacattctttttttctagtctttgaaatttggtgcatattttacacttatggcacatctcaattcagactatccacatttcaagtgctcagtggctgcatgtgcctggtggctaccatattggacagcacaggtctaaggatttcattcctgccacaagtccaaactcctagctttaattttgagtgtttttaacaaactggcctctgtttatcattctttcttctagtacttccccaaggatgattgtaccctcagcactcaagaccgcttgcggtttccctacacactttttgttcaagctgtttcttttacctggaatgctgtctttgcaccttcttcctggacctggttcactcttgttgcctaggctggagtgccatggcgcgatcttggcacactgcaacctccacctccccggttcaagtgattctccttcctcagcctcccgagtagccgggattacaggcatgcaccaccacgcctggctaattttgtatttttagtagagatggagtttcaccatgttggtcagactggtctcgaactcccgacctcaggtgatctgcctgccttcgcctcccaaagtgctgggattacaggcgtgagccgctgcgcccggccgagaggcacacattctgctaagagctttttcctgactcccctaactccaagagggatttgtcactccttagctttgtactcatgactggagtagaatgaatttaatttgagtttagttgtttttgagactctccctggctagtgtagtgtcttattcgtctttgttgtgatcatggcctgcacctaacagatgatcagtagatgtttgcagacagaaagtaaaccactcatcaggtgtattcagtcccgttcttgaacgggcttgctgcctcctttttgaggagatctgtgtatgtactcttctttcacgcatatgtgtgagcaaacacacacacactaacaagaaattcatctgaagatgtgcacaggaaatatcttgcatctttaccccctttgtgatcttacatatgggagaactgaggcacagaaataagttaggacagccagcaaacttgcatcagtataaatacaaagaagggaagggaggaacatgcttgaaaggggtgtgctggtctcagagggttaggtttctcagttggctgggcatcagctggccatgctttagttatttgatgggaggaaaaataagtgggaggtgaggagtaactcctgggctctgatgagtattataggcaagtacagatctggaaagcctgtatgcaaaggaggaactcactgaaaagtgctggcctgaggagggcagaagggagggctggggaagccagcagggggagcaaaggagtaggctccagctgggtgaagatgttggtgtggtatgttatgtaaaatatacaaattattattgggaataaccacgtctcagcagtgcgagttctcagtttgaagaatgggaaatggaaaggatcagattcagagacggcaacttactcaaggtcacagcattttaaacccaaatgaaatctcctaggcccttcatgccacactcatccatccctacctacttgtgttgcaaccaagggccccactgtagtgcctaggggagcaggtctagggcatagtgccaggcctgattaatgtcttccttaccattttccagcgaggggctgtgattaggcctatttataggggcctggtcccttaatattctgcctggtgcatctcttgccaatcaaatcagtgctgtctgcagtgtgattgctgctttagtggcaccagggagaggagttaattaaacccaatataaatagactctgccctcactgtgcaattccaggagtgtttttccttcctgtcctctacccccacaggcacctctttcctcttggccccctaagctctagcctgggtgagcagggctggatactcctatacctagagtcactagccactgcccagtctgtttcaggagcaggcctcaaattcctcaggggttaaagtgggaagaacccgtgtgtgcgcattttttgtgcttttccagaactgggtaccatttggcagttgatcacgcaatctcccccgctaccccatttctacccctttgtttccagcctcttctttcctctgcaaccaaggtttcttgtttatccaaggtggggagctgaactgagacaatgtatggaaagggtgcctggcaggtagcaagcaccttgtagggggtcagaaatgttgcaccttctctgaactcctccattgaccctacagattccccagtccctggccctgccctttccctcattcactcagcaggcatcagcagagtcccatctatgcgctcctggcctctcagcaaatgctctgtcccctactcccctatctgtgcaggctgaagctatgtgcatagttgggatgagggctgtgttgtctcaacaccacgctgccctgtggtgggggcgtgccggtggtcgtgggtggctctgatgctccggctccgacccacaggcaccatgactcctgtgaggatgcagcactccctggcaggtcagacctatgccgtgcccctcatccagccagacctgcggtgagaggaggccgtccagcagatggcagatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagtagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcaccaccattgatttgagtgcattaactcacacttcatgagcaggcactgccgtcatctcattttatagatgaggaaactgaggcacagaaaggctgagagacctggcctagtgacagagccaggattcaaagccatagatcatggtcctgggttatgtaggttattactgcatctgttcaggggagatggggtactgtgaggctcgtcatgggaagcctggcttggtctcaggtcagggaaggcagatgtgaggaaatgacatttatggtaaagtctgagggttgagtgggtaggttgggaagaacattccagaaagaagcacatgaactacagcctggaggtggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctgtttttttggcaaaggtcccaggggttgtcgggtacacaggtcctgtctttggccataagcaaactgaaatgaggcttggtctccttcccaggattccacaccatgcctcacatggtagaccccagcgggaagtatgtgactgcctgactcaggtgcctctcgtggtccaagccatccctgccctgtcccttccctggttgttgccagacctggagcccctgctccttcgctttgcagcctcctcttctgtcaccaactgggaacccacttcttcctgaaagtcctcccccacggactcaccggcttgccccaagcttgtcaagaatgtcccagtaaccaggggacacacactgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattgtaaatattaaattaatcaaaacatgcaaaggaatggaacagtgcctggcacctaggaagccttcaggaaatgctatctcttccctgttgataatcttgacccgtacactgcctttggttgccattcatgaacctgccaccaatagtaacaaagtgctggatgcaccttttgtgcttatctttgtgctaaatgtgcccgagggaagcctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgcgttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcagaaattaaccaatcagtagagcagccttcggagtaagggctaaaatgatgtcctcagggcctggttttgctttccttccatgtcagtttgcttctttgggtctggctgcattcccagacaggccatgctgtcgtggtagcaaggtgacatgacacagggtcaggtccagcaggaaagaatgctctcctgtgtccccacttcctccagaagccacactcacccatcccacctggcttggtcctcatgtctatcccagaatccattactggggccaggggactatgacacaaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacacagggcagactcctggaagaggggggcagggtagggaggtggatatgcaggttgccctggtggggtctggaaatgggggccgcaggcttggagggaggcctcagtgtggcttggaacgtggtgtatggtggtctgccgcgaaggccggcctgcacaggggtgggaggggggtgcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcacgttgattcaggagtgttagggagctgtgattggattttgagcagggcagggatgggacagaagagtttggggaaggttcctcaggcatccgtcacggaagggataagaagggagagagagtggatgccggggacacccagaagctgttattgtagtcaggatgtgacaggggtgaggctacagacaggggacttgcaagcagggagggcagggtgagacattcagaggaaacgacgacaggaaatggtgacagatagggaatgaggatgaagggaagggagagccagtgacgactggcagtggagtggggagcaccgccacctctcctcctccacttgcccctcctgtggcactggacaagttagtgggcttttcgttgtccatgggcttttttggtggggatgtgaccagctttgaacccttccccttaaacatgctcctcctgcacggaagagacaggggcaggggagagactctctccccaccacccagctcaggccccagcacagcccggcttctggcctcactggcgtctgtgcccagtgacgcaggcaggtgagctcctggcaaattagcattgcaggctgtgctctctcctcctgctctgctgcagctgggagtgtgcagagactggaggggatgacagtcacccctctgttttctgtggtggctctgttttctgtggtgctggatgcacctctgttttctgtgttggctcccagagagtgcacggtccctgctgattgaaagaaggatgaagggcagaagaggggcggggagctgtgtgccctaagatctcattgcctttttatgccgattaacatgcttttagcccctactgagcttatagttaacagaagtttccaggtctttcttcacctgaactgtgtctaaagcaagttccctccaccttctgtatttatacgcttgatttttaaaacctaaatgggcttcacatttattccttgtaaatttcatcttggtgattgcagtctaccctctggcctttaaaaattgtctgagccttgattcgatcatgaaaccagcttacccttcccctgtgtgctggccccagttttctaaccaggtgttgaatgaactgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgactcgagatgcactgtgctgcatgttttccccgggcacagcaggctaataatcctgttacaaagagaaatgctgtacatttcgagcagtgctggcccctgggactcaccgtggccttttctaagtgcttacagactctgtttaataatccattccagaaattttccagggctcattgttgagcttggtgttcgcaactttgagtgatcagcccttctcctttgtgggagcaccaggacagagcagcctttgtccctccccagtctcagttccctcccattgcccctgtggacctcgaatgcagagcttatgcacctactgaaggtcgtgtcagcacccaaggcagaatgaggctgtcctgggaactagggtaaattaaaacagcttgtgctggaggaccctttacagcagatgaaggcctctccccagccagaaaagatggagcacacgctgggtggtggccccgcttcctcactgaaaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagacccattagggcacggggacttctggattgtgaaattggctctctgggggccaaggccttctaacgttggtggaagtggctttggcttattgggtcggattctaggccattcattccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcgcgcctctgccttctcatccctgcgcaccacacaggctcgctcgtgcccggtgagtgctgaggctgctctgcacatggagtgtggccctgtgggcaagggctgggctcttggaggtaggggagctacaggggcgactgggaggaggatgtcgtgttacacacgcatcagagttaactttgcagtgagagcggccttgctgcggccaaagaacatggaaaagcatgagtggggtgatgtgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccctgcaccagggaggatggaagcaggtgaggagctagaccacactgaggcggtggtcgggactcagggtttgctcagtgagccgttcactatgtgcaggggcagttccccgtctgaatttaggtgacgacactcaggtccagccttgccagtctcagcctccggtctccgttccccctctgcagaggccactttgtctgctgcacgtgatcatgaggggctgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatgcccctgtgtcctgaggctactgggcagtccctccatttccccgtgcctctgaggctgcccagtctctgccctgctgcccacctgtaccttgggctttcttctcgcccaggctcccaactccaccctcttcctgccaagcaatcctagccctctgagcctcttggggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatgctggggaggagccggggccaccatagggttctgtcccccagaggaggctgactgggatggggtggcagctgattaggcccagcaccaaatattcaccatcccttggccatcctggccctcccaggagaagctgaaggactttcctgtgtgcgtgagcaccaagccggagcccgaggacgatgcagaagagggacttgggggtcttcccagcaacatcagctctgtcagctccttgctgctcttcaacaccacctagaacctgtatggccagaaggcagggccgaggggtgtgggcgggaggcccggcctggcttagtggggacccagggcatcagacacaggtacagcacatgggccaggagccagggggtgactggggtggctcggctcgggaggcttgggaccccaagtgcacgctgtgcccctgatgatgtgggagaggaacatgggctcaggacagcgggtgtcagcttgcctgacccccatgtcacctctgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcctctccagtcaaggctgttgggccccttattccacccatgggaggtgcacacaaggtcttgttggctgcccctgcaggtccctgtcacctctcacatgtccctgcctaatcttgcaggtccctgagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggtaggtgagctgggttctgggatgggagctgggccggggacctccctgctcacacaccttcttccctagacaccccacactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcggaagtcagtgcccaggccccacacagtcttcaaaggtctggcctccccagcgtggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccaccgggtgctttctgcccaacccctgctcttgccagctggcccctgcttcccctagggcacatgctggaagccctgggctgccaccagaggtcctcagccctcctgcctgggctatggctccttcctggtttgggagccatagtggagctttcctctctaagctcacccagctcaaactgtgacaggagaatcttcttcgactgccaagagcggtccaaggcaatggtcagccactgcagcctcctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctgtccccgaggtggctgggaggtggctcctcaaacagccgctttctcatcagtgcccagtgctgggtcagggatcgactgaggctctgagctaactgggaaacacagtggccttggagggctggggagtgtcatgggggtggggacagggagccaccggtcgcatgtgactgaactcttcaccccagtctgtgactttcccgttgcagtgagagccacgagccaaggtgggcacttgatgtcggatctcttcaacaagctggtcatgaggcgcaagggtaggaggcagggccgctgcccgccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgtgtgtcagactccatccctcctctgccgccaccgcagcagccacaggcagaggaggacgaggatgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcagaaaccaacagtgtgcttttaataaaggacctctagctgtgcaggatgcaaacgtctcggggtcagtgactgcctcctgcccctgttggtccctaggcagtgggggcagaagctcccagctgacctgtttctctgggatgagagggaggagagaagggcagttagcaggggcagctgttgcagatgggaggaatagtctcccacaaaaaaggtttcagtgacagacacggggtctctaaaaatagtcatgctgagagcctaatggcccttggcacaattgctggtgttggggtagaagatgtcttggagtttgctcaagtggttgagagggagggaggtgccatcgacttggaggaactggcaccaagccagggagatagacatccaggcaaggctgtggggcaggttagggagcaaggctgcaggagtgactcaggaagaaggtgggggaggtgacaagccccca

SEQ ID NO: 14141 - DNA, 569 bp, Homo sapiens
gactttaaaatcatacatttatccctcacagttctggaggcttggaagtccaagttcaaggtggcagctggacgggttcctggtgagggctctcttcctggtttgcagacagccaccttctcttcgcatcctcacttggtgggaaaagacagaggagagaaagagagagagagaaatgagatagagagagagagagaaatgagatagagatagagagagagagagagagagagagagagagagggagacagagagacaatgctctcttttcttaccagatctataatgagggccccaccccatgacctcatctaaccgtaattacctaccaaaggcccatctccacataccatcacattaggggttagggtttcaacataagaatttggagaggacataaacattctgtctacaacatgagtggagatccatctcttccttacctctggtaaggggaccacacgctgcagccagtgagacagtggcatgttcttgttacaactcaatctaactcccccagaagaggaggcagggaaggcggacaaaactgggagagggagagagtgtta

SEQ ID NO: 14142 - DNA, 1795 bp, Homo sapiens
ttctttgggattcccgttttctccaacgggcactaatgcctgtgcctgggtcctggcaacactctggactccacactctcctgggtttcacctttgtagcaggatccctgcagaccaggcccatgacaaacaccgtctccagcgggcagagcaaaggaagggcacagcgccaggcagtggtgcagctgcctgtcaggatgaggcctacttctagtgaaactgggcagacaaaaggcagtgagaaatgtgatctcggggtggtggaggctctagggaaaggaaaaggcaggagtgaacttccacacagcagcaatggcagaaccaaaggtggctttgacctccacgagggctcagatccaggccaacagcttgtccaggacagggtgccgggtgtatcactggtccaggagcactatgctggcagaatccctttggtgcctgatggccctgccttcgtgggaacagaggctaaggctttgagttacagctgcctccccaacagtgcatccccttctccctcctcagcctcaggtaggagacagggcaggcaaccccctttcctcttctccccttctccagcccctgtctgtccacccagctggaggcagccaggcttgcctatggactggttgacagccttcatgcagaggttctccaccagagcctttcttgggggcccctggcctgggctctgagctgggagtgaaggggatgacccatgcggactgtttgctgcttgtagctttccctgggaaagactctgccaggccttggagccagaccaggaggctttataaggccaccgcaagcagcagggctccagatgacatcacagggaagatcaagagggtgtggaggggcatcgaagcctctccaggagacaggagacgctggtccagtagagccctaggggcgacgccactcccactcactgtctactctcctctcacctctgcaacactggggacactcacaagagtgtgatccaagtcggccgtcgtcttctgcagctctggagacctgatgctagggaagggcatgcctggcatcaccacacacctggggggagacaggagcctggggccggtgggcccacacatcaccagctgctccgttctaccatttcttcagccctcttggctgtgcctgcagctctgcccctcccctctctgcacctaccacccagagagggcttgttgagctcagagatcccacctaggccaatccactgggttctgcggcagcgatggcctgcctgatcttccacctgctctcccagggccaaagccagacctgctgagcccctccctccagccggctggtctgagcagtcacagcccggctttgggctccgatggcagcagacggcaggtaggggtccagctgctggagcgagggccggccacctatcacagccaaggagatgagcacaagcactacttactggcctaggttgtcagagaagttgatgctctcactcatctttcctccaatctttcccctatgcctggttgtggtattaagttacatgcagacaacaggggccagaagatgaacaatggcccatcccactctaggcatggctcctctccacaggaaaactccactccagtgctcagcttgcaccctggcacaggccagcagttgctggaagtcagacacctgcagatcaagaccacagcatcaagaccctgtgacctctcaaaggaccggtggaaaggacacgggaagtctgggctaagagacagcaaatacacatgaacagaaagaagaggtcaaagaaaaggctgacggc

SEQ ID NO: 14143 - DNA, 3787 bp, Homo sapiens
gccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactacgagaggctgaggcggaaaattgcttgaacccagaaggtaaaggttgtagtgagcccgtatcgtaccactgccctccacctgggcaatagagcgagaatttgtctcaaaaagaaaaaaaaaaaaagaacatttatgccaggtgtggtgggtcatgcctgaaatccccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcgctggccaacccagccatgaggtcggacctgacccaggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaa

SEQ ID NO: 14144 - DNA, 12803 bp, Homo sapiens
gccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagacttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggtgatctggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaatatatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggtgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacat

SEQ ID NO: 14145 - DNA, 90 bp, Homo sapiens
tatttttagtagagacagggtttcatcatgttggccaggctggtcttgaactcctgacctcaggtgatctgcccgcctcggcctcccaaa

SEQ ID NO: 14146 - DNA, 104 bp, Homo sapiens
ccagcactgtgggaggccgaggcaggtggatcacctgaggtcaggggttcgagaccagcctggccaacatggtgaaaccccgtctctactgaatatacaaaaat

SEQ ID NO: 14147 - DNA, 1674 bp, Homo sapiens
catacgcagaaatggttaaattctgacttggaattccatgggaattagcaggctgtagacgaggttctggccgagaatgtcatggttggaccaagacttcccatggggctgctgtttgtggccagtttcttgtttttatttatccaatgtgtacatatgcccagaagctatttgtaatgggagtgttttaagaaattcataaatttaaaacactccacacatacaaaactctttctgaaatgtgacatcttaaaattattttctcaaagtgacataaaataaaacagcgtaacagccatctctttgtaatatgctctcttatatttaatttttattaatcttcacctaaatactagataacatcatgaagagagcaaaataaactggccatctcagtttaaatggccaacagtcatcttttgatgtttatttctttgaaacaaaatgcaccctacattttattttggagcaaacagtcatcagaagtaatgtgaatttgtatgttttgacaaaaagttttacatatatgatttaaaaggtgtttatgtaatatgaattaacttgtgtacaaaagagatacagatttttcaaagagcaagcatctgaatgttaagaactgagttcattgaggttaaattgttctcaggaagtttaaggtaaaaaagaaagaaaaagattgtacttctcctatggcaggaagaggctcatttccagggtagagacttctgaaatccataaaatacattccagatccaagacttcatgcatcatacctggacactgctgtcatagagagagacttgtgagtggtttcctttcatttactgaatagagataaaaatgcccaaagcatatgtgagggacaaattttaaaaattaatttaaaaattctgttctgtttaacactaataatctctaatgtatccaacttttcaattattgaaaatccaaaagtcaaatgtggagcaaaccttgaaacatagagcagtaatgaatatctgctgccaatagcaaaatattcaccaaaattcaagcagaaggtgaatgtgactgaatgagaggtccttaagctttttcatgccatggaccctttggtagtctggctaacgtttctaataaaacaaaacacaggcttataaagaaaatcaatcatatggaaatgaatgttgatcacaatatttaaagaaataccaagtttgtgatgtagtaatatttgtgtctttattaatgctataaaaggcaagaatgaacaggaggcttgatattgactcctttttgaagtaggatgagcataaatgatacattgaaatatctgcaaagttataatgtgatatgaaagtgtctgtaatttttattcctggcaatgtgatagaaactgctagtaatactgtggtttgttgaaagaaatgctacatttcagataagattagtgaaattgaagatataatttttttctattcaacttcatggaatctgaagaacgtaggttagaaagccctgatgtaaatgtacaatgcaaggtcatggccataaatgtatagtttcacatatttgcctttggtcaagattttgtctaatatcttggttattttagccagtgagtagtatttaccacatgggttttcactacaaagaggttaaaaataaaacagcaacaacaaaaaacaacaacaa

SEQ ID NO: 14148 - DNA, 28766 bp, Homo sapiens
ctctgtccccagtaaccccggctcccctcctcccccacccgctggaaaccacgactccgccgcccacctctgcatttgactgctccaagtacctcaggaaatgacctcatgcggtctccgcacgttcgcgtccatcttgtttatttccagcgtttggcccgtgggagcgatgagcgcacctgttcagcccctgctttcagttctttcagggagttctcacgtggtcttcagaggttcccacacgctgcttcccacagcagctgcaccattgtacattccaacagcaacggacaagggctccaatctcttcgtattcttgcaaacatttactattttatgtggtttttttttcttttctttttttttttttttttttgagacggagtctcgctctgtcgcccaggctggagtgcagtggtgcgatctcggctcactgcaagctccacctcccgggttcccgccattctcctgcctcagccgcccgagtagctgggactacaggcgcccgctaccacgcccggctaattttttgtatttttattagagacggggtttcaccgtattagccaggatggtctcgatctcctgacctcgtgatccacccgcctcggcctcccaaagtgctgggattacaggcgtgcgctactgcccggtttgaaaaggcaattgaggtttctaaactcctactaaaggaaataattcctagagttgggctgcctaagagcttacagagcgataatggctcacctttcacagcgacagttacccgaaacacatcttcagccctaggaattcagtgccgccttgactcggcacggaggccacagtctttggggaaagtagaaagagctaatcaaactctaaaaaggactcttgctaaactatgccaagagacatcagaaacctggaggtctttattacctgtagccttattacgggttcgaatggcccctaagggaaatctgcatctcagcacttttgaaataatgtatagaaggcctttcttaactacagacctcctaatagacatagatactttcaagctacagaattatgtgatcaacttaggacaagtgcaaaacgcactccttgactatggaaatcagagactcccttcccccactgaggaagacaatctggttccaacccagctgggagactgggtcctattgcaaacttggaaggaaggatcctcagcagatcaactttccccccaagtggaggggactctatcaagttctccttagtaccccaactacagttaaacttctgggaataaacagctgggtccacttatctcaaattaaacctgtctcttataaagccccacaggccaacggaacacaagagactgatcccgtttattcccgtgagccagtcagtgacctctgattcctgttcctaagaaatgagagggatggggggcataaatacctggattggcattctacttttaggcacaagttggaatcatgcagagagtgatttatttactgagtaggcacagactttagcctgtctacataatcacataaacggttgggtatgtggagaattgccactttcctccacctctgggttgccctggcatagtcaactggccagcctaagtctgtggggattttacgttccagaccattacccaggctatgagagctttagagctcacgtctctgccattgatgagctgtcagtcagtcctctattggcttggttccaacagctgcccagttcttggaaagcctttctgtttagctagtttacttggaatgattttatttattttgctttgctattgtagaatatattgcggttgtactctttgtgtaggaatgcatgacaagctcactcaacactttcttcagttggacatttttttgttttttttttgtttttttttgagacggagtctttctctgtagcccaggctggagtgcagtggcatgatcttggctcactgcaacctccaccttctgggttcaagtgattctcctgcctcagcctcttgagtagctgggattacaggcgcacaccaccatgcctagctaattttgtatttttagtagagacggggtttctccatgttggtcaggctggtcttgaactcctgacctcagatgatccacccgcctcagccttccaaagtgctgggattacaggtgtgaaccaccatgcccatcctgtttttccttcttaaatgagacaagagggatagagaatggggctgtgtgtttcccttcccaacataaaagactggagggagctggagttgatacttcccttcctccaggttggttagactctgattaaactctggtacgttaaaaatagtttctcttgagggcagaggaagaacagaatgctctggcatatttcgaaagtgctacttctcccctccccttgtccaaagcacaaggggatttttctctggtatttacctgggggatctggtagagtttgtgcaggtaaaactcacagaagtgtggcctccaccctaagactgggccctggagtttttaactgtcaagcttggccacacagcctccagcaatctgccagtgacagtttaggttttcccaacctggcagtggttcccagggaggtgtctgctctgcagaattgggattctctgcatctgtctgtcgtctctacaacttttttgggcagtggtttgccctgtgacctcatcatctgttgaatataagaaatattattgactttcagtttgctcacgttttgttcttgtgaaaagattgattgtttccaagcttctcacacagtggactagaaattgattcatttcatttatcctttttgggtttgtggggttcttgaatttgtgacttgatgattttgattacttttagaaatttcctggctattaactctggagtattgcttcaacctcatgttctctcatctcctctctgggatccagttacaaatatattggtccttcttcctgaatcctttgtgtatcttaacctgtcacctgtattttccatttgtattatccatacttcattctgaatattttctactgacctattttccacttcactaattctctcttcagctgaatttgctattaaagccactaagtttataatttaagtgattttatttttcagtgctagaattttcatttggtttttctaggtttttttttttttttttgctgaaattctaaattccacctctatttctgcaaatgctgtaagcacagttttgttccagtctctgtctcgcgactccagtgtctggactggtagatcttctgcctatggtctctgctgctttcattcttgctgatttgttttttcaattgtctagaatttttattgtggactgaacattgtatttgtaaaattattttgtagaaatcatttgaggtctattttattttcctccagagagggtttatgtttgcatctgcgagacatgggggcactaggggtcctggatcatcttactctagtttcagggattgaaatcatttcaagatgattacagtttaggttttcctaccctggcagtggtgcaaaaggccctgagttgctgcaagagccggtctccttctatccacccctatgtctagggtgcggttatttgttgtcccaactcaaaatggtgggggtcggggggatgttcgccaactccccactctcaggtgggctgaatctctcgctgtctggctcctcagtgggctgtgagctatctgaagcagcaaatgctttgggggaaaagtgagcgtcccgaaggcttttttcactctggatctttgtctttctgggattttgtttgtttgcattccaagcaaatatttttaacattttgctcagcttttgtagtcaccatcagaaaagtgatgggtccagattaactagtccctaataaccagaaactggaagtctgatggttgttttcagtcttgaacaacattgattctgcggtgaccagtttagagttcatgcaatagaccttcctcccccttgtaaaatcatcactatttcagctaatacttagagtgacctcctggtgactcatcctcagccccctttgccggttcttcttttccccgacattttcattctggagggcttgggattcagtcctttggcctttttcctagctgtgtctgccccctcggggatctcatccaatacccttcccacagcctacccagaccccagtgctgaactccagactcacggattcagcggagcgcagaatgtcagatgtgtgagggccgcctccgatgcagcgcgttccagatggagctgcggcctcccccagacccgcccacccccacccccagattctgttgagggcaaatcatgcttcctcgcagctcacaccctgttggttctccctcccacgttcatctggaatgcggccgctccccacctcttcccgcctgccctcagtcagcacagcagccttctaatggcttctgccctcccatcatccccagaccctccctttcacacagcagctgtgaggtcctcctcaggcagggtcaggtcacgcctctccctctcagagtcctgcctcagcccctcccctgtcatcaacaaagactagactgtgaatggccccatctgcctcctgcctcccgagctcacagcctctgaggtcccggatgggaaatcccaccaggcagtctgtggacgccgcactgcaggcgagtggggtctatcttttcaaagctgatgcccacgcccagagagggtgtcttccatgagagacgtggcctggcagctgctgctgtgggccctgggcccggggacacacccggccctcattgaagacaggaggcatcccgctgggggagtcagatgagatgtccagccccacgtcacctccctgtgctcggccgtgctccgtgaatggcctggtgggtttctgtgtgtggagagctgggtgggcttctagggtcttgactacggggctggatgtagagtactctagagaggctggggatgagatgaggcagctgcaggtggcccctcctcaccgcctgaggacgcgggaccacgccaggcttttctgggcagggtgcccctggctgtgtggcaacagatatgcacagaaatgccacatgggctcctgaggcagcctcatgtctccactggtgggtggtgtgggagaggggacctgagattttgcctggctccttgctatttgggggacgggtgtgcctctggggtcccagctgtgaaccaggttgtttcacctggggtggggtcgggcttggctctgtccccgggtcctgggctttcctgggctcccactcactgccctctgggcagctgggcctccccacatccctggcgcgctggggcagccccatcttccttcctgctgctcaagcgagagcctcgccaccactctgagtgccttcgctcacgctcatccagtgcatttgaaatccccgtgctccaccttcccgacacccagagtcagccccatcacaggtctcatctgcacagggctccctgcctttccctgtctccacctcccccacccctgcccagtcagccgcatcacaggtcccatctgcacagggctccctgcctctccctgcctctccctgcctctccctgcctctccctgcctctccctgcctctccctgcctccacctccccccgccccgcccaggcctgcagctcctctcacccggtgctccacccctgcatctgggctgctggggcccccgtggccatgacagatgccgcagaggcgtcacatcctttctgggtgtgatggcctcggcttctgctcgctcactgcccggcatctccagtccagcttctcctgcagcatggagagaggccacgtggagggtgtgcccagcccatggcccacccaaggtcccctgtgtattggtgaccctgcttggaccttgcaacccagcccagccccacgggatgcagccacgaggtcaacccagccacacctcatgaagcggacacggccaccccgacccttctctagtcctgcacccagagttgtgactgtaaagtgggggttgttttaagccaccaagctctggggtagtttgctccaggcagcaggtgactgagacactgccctgtgggactccccatttctgcactcgctcccctgtatgggggctcctggatcatgccagggtcacgtctgataaacccaatgttagttgaaagcctccagatgaaaggcactcagtgcactccgcctcctgaatatcattgttcggcctcccggccttcaccatgtgcagacgctgacgtcagcacattcgacaaagtccccaattcccttgctctgtttctaaggccccgccacccccacgctgtggctgcgcttccttgtcctcatccttgtccacctgtgttctttccaggtgccctgagtggactggaggggcacagggcagcctggcacctgctgagcccttgctggggccatgctgtcctgagcccctgctgagcaccttatggggacatgagtgggggctcagtctgggaaggaggaggggaggcctggggagatggtctgactagctctgcccagcccctcggtgctgtctggggacaggctggggtccagggcctccccagatgatgggaccagtgtctccagggctctgcaggctggtcggggcggctgacctgggcatttcttcttctggctgccgggaggcagcaaggccccaggtttgcatctcagtggccaagtctgggcgaggcttttcggggagcaggggtgcagcggccaagtgtgtctttggccactctggggccacatcaacgggtcctggggtccctgaagcacccgggaggcagccaggagggcgccagtgctgggctgtgcagggtgggcctgaagaagggggtggtgcctggcggtgatggagtgggcccgtcccatcccccaggccggcagccctgcctcaggagagccctcagtgggctgcagaggggcctcccacggtgagagaggacggggagggactggagtgtggttcatgtggtggcctgctggtgcagggctgggctccatgttggcagggcttgcgggggcggtgctgggcttcacagtggcaggacttgcagagggggcctgggctccatggtggcagggctggtgcagggctgggctccacagtggcagggctggggggtctgtgcccacaaggccacatcaggcacaggggaccagcccccaggacagaggtcaaggcctggattttgtggcccaacctggacccctaactctctccttgccccacagtgagtaaaccgaggtgcagtcatggcgcctgcctcctgccgtgtgtttaggtgaatgaggtcaggccgggtactcacctgtgcatccccgctgctgggaccacagcaggtgcacccacggaccccagccccactccgaccgcctgtgtcctcaccctctgcgggctgaccctttccccctctggccagtggaggtgggaaggctctgagggcccctgagcccaggttccctctctgtggcccttagccctggccacagcactcggaacttctaaccgagccctgccgccatagcacacggtccgtggtgcagtcacctgacactgcaccagggcgtgatgtccacaggcaggccatgccccggctccacacagcggccccggactggagtgccccccgcagagacagcgggcaggaggccgtccttcggggccaccactgtgaccatgagatgcccagccctagagggtcaagggtccgtctgagctgcccgagaggtcctctgggctgagcagggagtgcacaggtggtggccgacgcctgctgctgagagcgcagctctgcggtgttgatgtggaagcagctgagccctggggcatgggctccaccagggccctcacggcctgcgagactcagggctggggactgggtgctgccatgtggtggccctgctgtcagctgcagtccccagctctgacctgcagagtctcactgtctcctttcggcgtttgcggagttggtgcgtgtgccctggccgtgctcggcaagggttcctcccggataaggtggaacccgatttggggtgcgctggtatcactgtcgcaatgatgcagtgtcgtcccgtctgggaacaaggcatcttgccatttatttaggtcttgaatttttctcttcaatgccttgtggtttcagaatgcggcttttccacagagtttgtgagattttcctatttgtcccacctgttcttgctgcctcttctcttgtatcgtttgggactaacggacctttcacatgactctgtgcttactgtcactacccgcttgtttgatactcccttccttccttccttcctttctttcttttactttctttgtctctttgtttctttttcttttcacagtcttgctctgtcactcaggctggagtgcagtggtgcaatctcggctcactgcaacctctgccttctgggttaaagcaattctcctgcctcagcctcccgagtagctgggattacaggcatgagccaccatgcccggctaatttttgtatttttagtagagacggcgttttgccatgttggccaggctggtctcaaactcccgacctcaggtgatctgcccgcctcggcctcccaaagtgctgggtttacaggtgtgagccaccgcacctggccctttggcttacgtcttagtggccaccctcttcagtaggtaggcttctggtacgtgcttccagatcaccaaggcgtagctctaaagagcaccatgagttcataacagcataagatccgctcgccgcccacccgctcgccacccacccgctcgccactcacccgcccgcccacccgcctgcttgccctttgtactatcgttgtcagacgttttactaaatccacatatgttataaaccccacagtgtattatgaatacgtttgctttaacaggcgattatctttcaaaatttgaaaagtaataaaaacagcatttttttttttaaagagacagctctcaccgtgttgcccagcctaaactgaactcctgggctcaagtgatcctcccacctcggcctcccaaagtgctgggattacaggcgtgagcaaacacgcccagccagaaaaacagcatttttatcatccacatattttccctatctagccactttctttgtctgtgtagactcatctggtgtcattttccttctgcctgaataactttgatgtttcttgtaccgcacgtctgctggtgataaattctctcggccttttgttgaaaaaaatctttatttgcctacatttgtgaggatatttttcccgatgtagagttttagcttgacaggtattctcttctttcagtcctttaaatgtgctaacgcgtcgtctgtctcccagctcacgacgtttcacacgatgtcggctgtaattcctgtctctctatgtaacatgcctgttttctttgactgcttttaagatttttctgtgtcactggttttctacagttttattacaatggccgtgccgtggtttctttctgtttattctgcttggagttcatggagcttgtctagatttttgtccaattgaaaaactttattaaacattttttcttgatccctccaccacattagctgtgtgcagcatattgtggatttttttttttttttttgagatggagttttgctctgtctcccaagctgggatgcagtggtgcgatctcagctcactgcagccttcacctcccgggttcagtgattctcctgcctcagcctcttgagtagctggggctacaggcactgccactaggcctggctaatttttttgtagttttggtagagatggggttttgccatgttggccagcctgatctcgaactcctgacctcaattgatctgcccgccttggcctccccagatgctgggattacgggcatgaggcagcacgcccagccattggtcttccagtcttttttccctcactgggcttcattttgaatatttgctattgctatgtcttcacattccttaaaaaatgtcattggatgttattcctgtccatcgtgtttcatttccgatgtatttttcgcctctgaaattgcgtttaggttcctaaagatctgtcattgcactcttcagcacgcttatgttttcctctgtgtccttgaaaatgtgggccctagttgtgactgcggctttaatgtccttgtctgctgatgccatcgccgccgtcctttctgggtctgtttctgttgattcttttttctcctgatcctgggtcatacttccccctttgttgcatccttggtaatttttggctgcacgcttccttgtgagtgctacattgttaggtgccaggttttgttgtaaccctttagagagtgttgggcttagtcctggtatgtggtgaagctgctgggaacccgatgaccctttccaggctggccttgggtgctggcaggccggatgcaggttatctcagcgccgtagcagttccctttggagggctctcccggtgacgctccctccctgtggggatgcagcttattcctggcctgtgtgagttccaggtgctgtccctgttccattccccagggctttctcccatcttgcagtctcatcccaggcacgtgcaagttggtacctttctaaggctttcggggagccctctgtggacctcggtgctccctctctgtgcagccctctgtctctggtcttctgccccgtggctatgccttctgtctcctcagctcagagagatgtctgggttctgtttgcagccccttctgagtcgcagcatgggagctgtcttcaggtggtgagccgggcaagtgtgggtgcccctcacttgctctctcaggggtcatggtcctgcactccagaccccgagtctgaaggctgctgtccacgtgtgttgtcggtttctagttgtttataggggaggggccctttcctagacgggcaccggagtctggctgcttctgtccctgttctctccactggccggggaccatgagaggctctggtggggccggtgatgtttattgagtggtgacgtttattgagcagtggaggggaccggctctgtaaagcctcagctctgtgcaagcactcagcggcctccttccctcctgtcctacagacggggacctgcgcctggagagcactctgcccgctgaggcagagcccgagtatgtgctgccgtctgtctgtctgcagagcttgggagctggtgtgtgagggggggtgtccagagtcctgggcggtgggtgctgggttctcctactgtgggaagacctcagggcaccaagcgtggggctccctgatgtccacgtgggccctgcccatcccccccatcactgagtgcagagtctccctctgggttcccggatggttccagacgatgtgggtgcaggcggtaggtctctctgcagtgtggatgggtccagacgacgtgggtgcaggtggtgggtccttctgcagtgtggatgattccagatgatgtgggcgcaggcggggaggagtgaggggagcacggcgcagggccatgctttctgagccctgactggacacagcattgtatggggcggagacctggacgtcttgagctgggtctcgccgacttccccttccacacatcccaagctgcacaggaggctggcccgggtcccgagggcccctggaagctgccccagccgcgttgctctcagacaggggcgtcctggctgcagcgggggccctgtgccgcctgcggtgtctgagaaggcgtgaacgcctggagaagcccagggacagagactgcgctgggagcagagtgaatgtgtctgttattgattttctccacgtggctcccacgttattgcacacgtgattttgtacttggctgagattaaatattaatacattgaacattaaaagagttttcagccctttaaacaattgtttatggcacaattaaaaggcaaatgaatgatgttttttaggagcaagtttgttggcctgagtcttatttgtgagggctggagctgaggggaggccccttgagggggcgcagagagggaagccgtgtggcatggccacttgcagtgggcgggcatctgctatttattgaggcaagatgagggggcaggctgccctggtgcccctgctccagacccgcaaataccaggagcagcccctgacgagagaccctagccccctagcccatccaccgttttgatgtaaaccaggtttccatgagcctcccatgcggctgcagggggtgggggaggtgggtcagcagagagcgagccaggtgggcagatggggtgtgggccgctgccctgtgcagggtgctcccctctccctggtgaatggaccgtcacctctgcttcctggcgccagctcctcgtctgtctgacttctctcgtgctgtgacctgcagggtcaggaccgcacggcctttcctctgagctggggttcagtcacttgcaactgaaggatcctgactgagccaaactagttaaagtaggaaaagggcctctggagttttcagttacgtgaaccgagaacggcttcaggcacagtggagtccaggtgccactgctggcacaaagcctgggtctccttccatccctcagctctgctgtgtcctgggctgacttgactctgaggcagtggaaccctcagcgtggcaggagctgccggcagccccggaggaaaacgagcacctcttcctccagcatctgctctctcttggcctggaaattccgtcctgagtctccttcccaggtctcagtcctggcggtttgagtggctgatcagaatctcccgcgccgcccacaggagacccagctgggtccggctggtcagtgccaagccctggacctgcgtggtggcgcccccaaaggctgctcggaaccggcccgtgcaggtggacctctgtctgttggttcccctcttccctcttcacaccctttaggtgcttcctgcaagtctgaaaggaggtgcaccctggcccgggggaggtttgcggggtgaacacttaatccggactagtttcaggagggcttcctggagggggctgcatttgggtggtgtcctgatggagcagagattgtctttttggaggaccgggtcccatgtagaggctgtgagctgcccacacactcttcatgccatgcctctcctttctgtcccctgccgctccctgggccagagctggacagattcttcctgagcacctggtccaacccggctgaggctggtcagtggcgtggttaactcggggctgccccggggggctcctgccatctcaggattcccagcacggacccctcccctgcctgcctcctttgctcctcgttgcctgctctaaagggagggatttgggcttagcatgtccacccgatgccacttcttttaactgtcaatacggtcggcatctgccaacctttcccacggtgactggcccctccttgggccactgtaggcagagtgatggggtcaactcgacaattgctttcactgtcaacccaagttctgcctaattagggggaacggcagcgtggctgagaaaatgagggtgtgtgtgtttgagcacacgtgaggccttccaacctgaaacaacagctgtgcccgcggccccggagcctagggggctgtgtagccccaggcccctgacccggcccccaccctccctggccccggggtcctgtggtcgcccaccacggtggcaccaccttgcggggatagcacagaacacgggcttctcagacccagagttttgaaattaggcagatttgagtgatttttaagaacggggtgggagatcggaactatttcacattttccaaatacagtgaggctctagagtgacgtgaaaactggatggtgcagcacggcgatgtcagttatgtgaacagccgccaccctcgtgcgggcaaaagcggctgatgggaaggactggatctgtggctgccactccgctgctccgtggcggtggggggcggtggccgcccagtccactctgcagtgcgggagctgggctccgcgagctcctggcccccacgccgctggacactggccagcccgggtcgaggtggatctagggtatggcagacagagagctggagcctctgggcctcctgtgggaggcaaaccctcacttctctgtagctggaagttcagcaagcgagaagttttacgaggccgtcaataagattgcatctttgttctgatgccgcggtgcctgcgtgatgatttaaaaccgctgagcccgacgtgctcacgggccaggcctcattgtcaaggcacaaggctctgtcgcttaatcacacaccatgatggcgaagctctgatgggattaagcttcccttctgcatctccacctcccttattcctctcagagggggcctgtgaggccaggggcctgtgaggccaagcgcctcacaatcccgctgcctttggggacatcgtcatggctccaggtgtctgcaactctgctgtgaagggttccctgggggagccatcctcccctgaacgggcaccgggtgtcttgggaccatcccactccagctatggcactcaggtgaaccccgagtgttttgtgctgtgactgggaacccgggcattggcaggtgatgtggttccagctgcagcttcccgtggtccttgggaaggcggcttcagggacggtgtaagttgtcagcgtcacccctgggaagggctccgaagcagaaggatgggggtgtctgtctccaggacccagattgtcctatcgggaagagttgaacgagggtggggagggtctcctggggggacaccagagccgagcctgaaggtgagcagagccttcgccctgggtgagtttcgttctggctgagcagtttctctgtggcccaagggacctgcattggttttttgagttgggttaggggcagagagggggagtgatggggctgtgggggtggaggtgggactttgtttcacttagttttataccctccacgatgttctttcccatcaaggacaggaacacaccacccacaaaatgaccttggagagacttttgttattttttagataggaaaaaacaaaaaaacaaaaaaatccccaaacccaataaccatttgagctactttgatggtggaggcagcgaatcccggggaaagccaggctcctaagccccagacgcccctgcctgctgaatcaggtccccgcccagtgctcagatggtcacgggctctgggatcctgcgggatttggaggaagaggccgtgctgcgtccgggctggctctgcccacaccccggcgagagatgctgacttcacattcacctctgtgaagatcacaggatttaagctgtcagcgtgggacgggcatgtgctttaaggatgattgcgccagcaaagccgccttcctgagccatgcttatgccaggctcctcctgtctctgagcaaatgctggccgcccggcccgggagcttccggaagctgtttgctccccgtgtgcaggaggaaatgtgtgtctgcagccatgtgtgtgggccgctgtctcctgctgcacccggccttcctcacggcaagagctctgtgctctgtgggctctggaaggaacgttccgggccggtgtgtcttgagagtgttgggcagctgccgccctgggggaaggaccctcactaggctggcccggggcaggagcaggaaggatgcggctcagctgccgcctagctctgtgtgccaagtccctgcagggaccctggaagccgagaggggcggctgggtggccacgcagcggggtgggaggtgaggggcctgaggaagccgcggtgccgcgttccctgggcagcgtcgctcacacacagggaggctcattcacgctcactcagcacggccgtgtcaaggcactgcaagtacactgacacgcagcttgcggtgggagggacggtggggtcctcggaccacccaacacagggccgcagactgggctttgacaacagaaattcagtgtcactgtgctggagccggaagtgggagacctgggtgctggaggtttgctgcgatcctggtgttccttggctcgagaaaccatcacttggcctctgccttcatcttctcacctttccacgcctctcccgtgcgtgtctgtgtccacgtttcccctaagggcacagtcacattgaattagggcccaccctactctagcctgaccttgtcttaactaatgaccctgcagtgaccttcctcccaagtaaggccacatctcaggcaccgggatgacgccttccacactagaattcttaagggacccaattcaacccctaagagggatgcctgagctgaggtctgtcgtggacaggctggagctctatcccccgggcctctctcctgcctggtgcctcccatttaaggagcaggttgaaggagctgagacccccccttgggcattgagcactcctgtcttggatacaggcttccccaatgctgccgcctctctccctgacctcaacctgcttccctgcactgagcctcacctttgaacgtccttccttccccagcgcgtggagccccgcacagctggggcagctcagccgagtgcaggcggtggcaggtcccaggggctggtgtcttgggtggggcctggtgtccgaggcctgcagatcagccctgctagccctgcccagtgcccaggctgcccctttgcctggttgggggttggtggggcagggagcctggtgggcttcactctgggtctaccaggaaggtggcactaggttaatcattattgccccgaccccctccgtatgggggggcaggaccagctcagaaattttagagtaccacgcaaaataagaacgttgggcttcttgctcaaaaatgaagaattctgggacagcagtggcggagcatgcagccttctgagcgcagacgtcgggacaccagggacgctggccgggagcgagggaggggctttaccgaggaatgggtttcctcctccagccttgttctggagatcacgcctgtgcaatctttttaaatacagaacagaaaaaaatgccagccccctgcagcctggtcacgagaatgccaggatctcagggcacctgctggctgaccttcgctgagatagaatttacacactgcacatgctcccatctgaaagggatgccccgcggccttcagcacattcacaacatcgcgcaaccattgccactcattccagaacttccaccaccccgaaaggagcccatcagagtctccccactgcccctgtcagctccttgctgtccctgtggacttgctggttctggacacttcatggaatcagaattggtgtgacacagggccttgtggcgtggactacggccctctgagcggtcttgacctgttcacctaaaaccagacgctgaaattaaccaggcccacctctccaggccagggcgggtgaattcccggggacccagcccttgcctgcaccaggagagtaagcgacttattaatagggtaatttatgcgggtgcctgcgcaccgggacggaccagcatctatcatggctgttttgcgtttcttgatttcacgatgtctgttgtgtgctcaggcccctcctctccaaggtcccagctgtccttgccctgttccctgtgaagagtgaagaaccaacgcgggcggggagtggaccggtggggagagggccggtggggagaggaccggtggggaggggccggtggagagggggccggtggggagggggccggcggggagtggtttggtggggaggaggctggtgaagtagcgtcaggtgcgggcctggcgtcggcgagtcaagtcgagctgatccagggccttctttctgcagcttcatcaggttctcaattagcggagggcgctggcggtggaggagggcattagccgtgcctgctctcgggctctgcctgccagagtgccctcatgtggcatgagattaaggctcagcctctttcctgacagcaggttttccatttttcttctccttcctcctctcctggcaacaaagtcctttgctgggctggggggtctccactctgatccacttccctccttcctgcctccctcccacgccctggaaaccccggcccatgactctttccctgagggggccgcccgcagcctctcccccatgggggctttgctctgggcaccccctttcccccggggcgggtggggcagcggccgggactcaggaagatggtggcccagtggggctctctccttgggtgtgtgggagcggagtcccctcgctcttctgggatagaacgctccgttgagctccccaaactgctcccgtgccgagctctgggggagggagtctgttcagagacggtgcagtcctaccttttagaaggtacgcctgcctttttaagcagctcagctctcaacaatgcacaagtggcttgagtagaagagctgctcctgctgggaggcgcaggaggctgagcgaggcccaccctgcaggggcgaggccacggtttgtgttatttcccatgatgactccaaacgcacccgagtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgtctccgtgtgcaggtcccccgggcctctgcgtctctgtgtgcaggctcaagtttgccaacgtccatgcacgtctcagcctctcagcctggactggacaactgggcttcgggaattcatttaaattctacccgctacacgccttccctggattcagggcggcgtccagtgcattcatcacgcgtgtgctgccgtgaaggtgcggggaccccccccaaaaggcttccttccctgtcctgcgtcctgcccacaaggcggtgctgctggcaccaggcctgacctggcgctgccagtgctccactgttttgagttattgaccaacaattcactctcgggtcccgaggggaactggcctgaggccactcaagcagaggctcaatgaggaaagataaatatttcatggtctgggtcggtgagagagggaaatcaatagcgcatcccatcctcagtacggcgcaggcctcccacccaaggcagcgagttgcatcctccgtgccgcgcgggccctcccacccgaggcagcgagttgcacttccgggcttgttctcttcctccctttaaggcaaggctgcaaactgccaggccgatggcccgtgctgggagcaggcaggtgtcctgactccgcctccagccggtgaatcagagccctgagattcaccaagggccccctgcccgggtcgtggaggcagagcctggggctgggagaggcccttcaggacccctctgtgggagccggacgcaggcctggggatgttggaggtgggagcgcttccaggccccttgtgtaggaccagaggctgctccgaccctgctcggggctctggagacagaagaacggcatgagtgtttcacaaatggtgcagacagttcacaggtcaagacaggggacaaaagtgaccacttttagttaaaaacaggtgactccgtcccaggacaagcacgatgctgtgttaggtcccgttagtccccttggaaagctgtcggctttccctggagaggacctcgttctgtccacgccactgccctgcgagcgagagggagtgcgagcggggcgtccacgcgctcccatgggggacctggggctgcttcccgcttcccgattttccttcagcgctgctcgtggcgtgccctttctcccgtggcgcagtcaccagcaggacgtgtgtcccgctcacgctttgggaaacacggccttgtagcaggagctgctctcggggttcagcatcgggggtggcagagcccagtgcctgctggggcattgccaggcatcgtggagctggacccagagccaggggtcccagctgctgctcctcaaggaccctgtggctcaggaaagccctcccattgctaacgtgtcacccgaagggcttggggacctccacgcaggatgggcttcaaaagtcagctcaggcggtgccctggcctcgggtgcgcggggagaccactggcctccctcatgccggctccctgctgactgtctcgtgagctcctggcagcccttctagaatgttctggcgtggctccctgctcacgtttctaaagcaactatcagcccatcctcaattaccgtgtctccaggaccacagacgacctggagcagcaagagtcagtgctggggccgggcgcggtggctcacgcctgtaatcccaacactttgggaggccgaggcaggcagatcacctgaggtcgggagttcgagaccagcctggccaatatggagaaaccctttctctactaaaaatacaaaattggccgggtgtggtggcgcatgcctgtaatcccagctactcgggaggctgaggcaggagaatcgcttgaacccgggaggtggaggttgcagtaagccgagatcgtgccactgcactccagcctgggcaacaagagtgaactccgtctcaaaaaaaaaaaataaataaagagtcagtgctgggacgagaggcaccggtaacatggccagtgttgcagccggaggcgggcagggctgacctgtccagggaccagcagagctcgggcaggaggtgaccctgagtcgggggagagggggcgtgggagcctggggctgggggaggagggaggatgtcactgtggatgaggctggttcccagcctcaggagccaggcccgggcccctccagctccacctgtgctcacctgggcaggtgatgccccatgctgagcctctgctctctggtccttagggtgggggtgcagttcatgccccatgggctgggtgaaagaataaacccccacccagtgggcacgtgcggcgggcacccagagtgcttgaagtttccttgtgaggctgctgctgactctggggagggacggtgtcgttggagtggggccacctggcttggcccgttgcccttggcagcaggaatacagctgccctgggggctcctctgccacacgggcactcaggggtgctggtcgttgggtccaggcagggtgggggcaagagccactgaggggccctttgtttgcatcttaggtgacgctgcagaggtgagtggccggggcatccagagcttccctgaatgactgggccacgacgatgaaggcgtcagggctgcagcctgctgggcgtgccccagccaagttttcaggacggcctctgcttctccttcggggaaggagcagccctactccctctgatggggctgcctgggagggttggatttgttgtttgtagggaaagactggggcggagagcagggtgctgtggcccctctcgtccctttctggttcctggggctgtccgcacagagcaggtggggacacgctggctggatttcatctggatcagaggagggtgagaggatggtctcctggtggggagtgcagagcctcagctctggagtgtggagaaggatccagcttgttgggtggtgtatggtcagaagtggggacctcggggcctcagatctggcctctgatcccaactctgttcccctcggagccacccttccctcatccatcaggagccagtagcagccccaggacagctgccgtgggataaataaaaggagccgccttcaggagctgcctgccgagtgtccacagaacgtagcgtcttcccagcactcagcgggtcctgatgggcctccttcccaccgccctcttccgagtgtggggagctcaacccctgacttggggtcccgggacattcagttttgtgtgtgatcagggaggcagcgcctgacccacagaaagcacctgctactggtggggtctcagatctgtgcacacctgtgtcccgggctcctcactgtccgggtggtcacactgtccctgcgctgctggacttgggggcttgggtgcagccagccttgtgctcctcagcctccctggtacaggaggactgtccatctgcctggcaggggcaaggccgtcttcagcggagagacctggaggccacgtggtctgctcagaagtacctgcatgcagtttgatgccctgctgcagcaatcttgaaattcttagtaattttatctttgaatgctcgctttgtaagtgcaatctaaggatggtggcgtgagcatgactgaaggaagctggagatggtcagggtgcgagtccactgcggagccagtaggtgccagtggttcgagaggccacgctttcccttgactcagagctggccccaagtgcagaaaggaggtggtgttgctctcagatgcccacacaaccaaggacacatcccccccgtctccctgggactcccatgtgagctggccacctgcactgcagatgacgatgtggaaggagagagaaagacaggagaccgcggcttttcctttcagtccttcgtacccaacagcaactgagagggcgtcccggcagggtatgaatggccagcaggacgctgaggctgcgtggcgtttccaccgtgctgcaggaacaagatgcacatcgtgcaggagccgcagagcacgcgtgcagaggtttcggtggctttgccccgcagctaacgtgtgcgtgtgtgccttgacttatatttgcattacttagaatgacattcaatagcaaatgaaagacagccggcaagtcaatagagagaatgcggaaggaaggagaaggctttgtttgtggctctgagggcacttttcctcctgcatttgcattttgcactgtgcagatttgcaccgtgcagccacccgggcctcctcgggtctggggctccatttccagcacccccacccagcgctgtgggcccctcccccacgcacctcccccactttggtggtgacagttggttgtggaggaacaatcgtcagtgatgggtgaactagctgtgtttcacgtggcctcctcatcactctgccaagcccctggggcaggcacattttggctgccatcgactctagaatgttctctggtgtctccagggggtgtgcagagctggtccctcccagcgaggagctctgctcacaggttcacaccccctgccctgttctccaagatgggaatgtctgatgagagccccagagaagaatcagccgctgggggtcggggaggtgttggactctcttgaaacaaaggaggcccaagcctggggtcacggggctgggggtgggggtggggtgggagggagtgggcagtgacctgagaacaggaagggaggtggaggtcttgggtcacgggtgatggatgatggaggaacaggcccaggaggccctgcttgctgggggcttctttcctcttgcgtagtcaccctgtggggggctctcaaactcacagagtttggccgtagggaagtgcaggggtggcctgggaggctgcaggctctgggacagcctggctcacacaggagatgggatggcgctgagaggagaccccggggcgcccagcgtctcaggctataaggagcagccactcattgtgacacccgatggtgaaatgctgcattattatttatggtgttgaataatcacagcacaatcattgcaggccacagggcagaaagtgctaatgtagtttaaaaacagtacatttgaatctggacactggcaagaaaataggcaaaataaatacttttgtccacccctccctaccctcttttggtgacttggggtggcctgggtcggtgctcagcccagggtcccgcggccagagccaaccatggcgcgcctggtctcctccagataaacgcgcgcccacgtctctgctgggctttggaattagctcaatactcattcagacgcagagtgcgtgtgccctgccaggacagacgtcattgctgtgcggtgcttgagtgccatcaataagccacagaagagaaatccggaaacaagggacgcgcagcgtgattccgtgccacggcgtcaggagcggcatgtagcatcttttggtttgagagtaaaattccgcaatcagaaatgaaatccgagcaaagaagcaaagcgcacagaggctggagacgctaaagcatccaggcaggactccgccaggtgggcaggcagaggcctgtgcacaggcagacggtgtgcccgtgagcaggacatgcttgtagggtcacaggtcacccacccgcaggacacgcatgcaaggtcacgggtcagccaccagcaggacacgcatgcagggtcacgggtcagccacccacaggacacgcatgcagggtcacgggtcagccacccgcaggacacgcatgcagggtcacgggtcagccacccgcaggacacgcatgcagggtcacgggtcagccacccgcaggacacgcatgcagggtcaggggtcagccacccgcaggacacgcatgcagggtcacgggtcagccaccagcaggacacgcatgcagggtcacgggtcagccaccagcaggacacgcatgcagggtcacgggtcagccacccgcaggacacgcatgcagggtcacgggtcagccaccagcaggacatgcacacccatgtgtgcacatgggtaggtgtgctcgacccacacatgttgtgccatcaccccatccttgtccttggagaaagggctattggccatcgtgacggggagcctctcagctgcgactgggccctgggagccatggagtcttctggccgcctctcctggccaccaaccaggaaccccaggccccaggcccacggttgcatctgctgtgccatcctgtggacaaacggacgatccaatccagatggcactgcaggggactgaacggggctctgaaacccggccggagctgccctcaggccaccctcctcaccttgagccattcccctgctccgtcacctgtgtcaggcctgggtgccgccaggaggcctccttccagctctctgcaagctggccccgtgttcacgggcatccagcgggatccaccatggaaagacagctttctcagaggcatctcagcacgtgggcccagccagaacctcgagggcttctgtccctggagggcagggcagagcgggaggacacagggacacagagaaggtatcagctggcgagggcagggcagagcaggaggacacggggacacagagaagatggcagctggctgagggcagggcagagcaggaggacacagggacacagagaaggtggcagctgactcggcgggagcggaaggtgctgctttcttcgaggtccccctctttgcggctcacccttctccctctatggcccccttaaccccaacccccctcggctgcctctctgagtaaaggacaggccagcgccgagcaggtatgtcccctgccagggtcccccgcacacctggatcttctaggctggggagtagtggaaggatctgcggggctctcgaagccgtctgggaggaacgtcaatgaccagaggaaggaacaagggtttcgggtgggattggccaattccctgggtcatctcagaaccacgagcttgtcttcctgggttacagggtcctgagcttggccgaaaagggacaaacgaagggccgggtgtgatgaccctgcataggtttgacagccctgtgtccttccaaatcaagtgagtgggtctgggtccccggccccctccagcctggggtccaagcctccctggtctcctcgggcagtcagcctctctgctccagtgccgtcagttgtcacctacgtgggtaaaacgccaggagaggctggatccccagctcaccggcctgtggcccgggcatcctgggcttgcagagggagggccgagggtggtaactaggaggagtggctctgagccggggagggaacacggccagagggggatgaaggccacacggagcaccgcgggagccccgccgtctgcgcagggttcagcctttcagcctcgatgtgggaagtctctccatctgttcaggttttctttgggtctttttaccagccatgtttcgcagtttgcagcgtacaagtctcacacttcctttgcgaaattattcctaagtagcttattctttctgatgctatttgaccaggacgctttctgcatttcatcttggggtgttcactgtcagtgcagaaatatcctacgccccatgatcttgttaaactccttcgatcatcttatcaggttttacttcattttattttatctttgtagattccttaggcgattccacctacggcgtgaggcgtacttctacatcttttttgctaatctcggtgatttgagttccatgttcttgcctcactgccctggctggaacccgctgtgcagtgtgggaggagcgggaggggagggtccccttgacttgctcccttccgtggggagacggtcaggctttccccaggaagcgtgctgtaggtttccatagattcgagacggtcaggctttccccaggaagcgtgctgtaggtttccatagattccattgctaggttgaggaggttcactctcatttctggtttgttgaaagtttttttttaattataaatgggtgtcagattttgtcaaatggattttctatatcagttgggatgatcatgtggcttttgtcctttattttattaatatgatttattacattaattgagttctggctgttaaaccaatctttcagtcctgggaaatatcccacttgatcatggtgtacagtattatctttttaaaataaattgttggatttggccaggcacggtggctcatgcctgtaatcccagccctttgggaggccaaggtgggaggatggcttgagcccgggaggtcgaggctgcagtgagccgagatcgtgccattgcctgggtgacagagtgagaccctgtttcaaaataaataaataaatagtcgaatttggtttgctaagttaaaaaaattaagtaagtgtcccgctcagcagcattaattacattcacgatgttgtgtcaccatcaccaccagctacatccccaactccaaacagaaaccctgtctccatgaataacaactacccattcctctccacccccagcctctcttaacctagaatgtactttctgtctgtgaattaggctcttctagatatctgatgcaagtagaatcatacaacatttgtccttttgtttctggcttatgtcactcagcacaatgcttccgaggtcgctcagcagggggcttccgaggtcgctcagcacggggcttccggggtcgctcagcacggggcttccggggtcgctcagcacggggcttccggggtcgctcagcacggcacttccgaggtcgctcagcacggggcttccgaggtcactcagcatagtgcttccgaggtcgctcagcacagcgcttccaaagttatttacctggtagcgagtgtcagacttccttcatttttctggctgaatcctattcccatgggtggatggaccgcattttgtcctccattcatctgctgggggcaactgtgctgtttccacctttcagccattgtgagtaacgctggtatgggagcctaagtgtctgtttgggtgtttgtcttcattcttccggacctacccttgggagtggaattgctggatcgtaaggcagttcggtgttccactatttgaggagctgccaaatcgtctcccacggtggctgctccattttacattcccgccatcaattccaacttctccacatcctctctgaggcttgttattttatttttatttatttatttttttgagacagggtctcactctgttgcccaggctggagtgcagtggtccaatctcagctcactgcaacctccacctcccgggttcaagcgattctcctgccttagcctctcgagtagctgggattacaagcgcatgccaccacacccaactaattttttgttttttggagagcagccgtcctatcgcatgtgaggtggtgtctctgtggttttgattcacatttccctagtgaccagtgagtgctgttgagcatcttttcatgtgcttattggccattttatatcttatttggagaaacatctattcgagtcctttgcctatttttaaatggaatttttttgttgttgaagtgtagcagttctttataaatcctgggtattaaaacccttatcagatatatgatttgcaaatattttctcccactctgtggttgacgtttcactttcttttttttttttttttttcgtttttgagaaggagtctcgctctgtcacccaagctggagtgcagtggcgggatctcggctcaccgcaagctccgcctcccgggttcgcgccattcttctgcctcagcctcccgagtagctgggaccacaggcgcctgccaccacgcccggctaattttttgtatttttagtagagacggggtttcactgtgttagccaggatggtctcgatctcctgacctcgtgatccgcccgcctcggcctcccaaagtgctgggatgacaggcatgagccactgcgcccggctgacgtt

SEQ ID NO: 14149 - DNA, 792 bp, Homo sapiens
aaaatagtgaaactgttcacagatgggatgatcttatatgtagaaaaatctaaggaatctactataaaaaccagtaaactaataaataggttcaacaaaggttcagaatacaaggctaatattaaaaaatgagtagtatttctatagagtagcaatcaacaaaccaaaaattaagaaaacaattttatttataataggatcaaaaaaataaaatacttaggaacttaagtgtaaaacttatactctgagaattctaaaacatcattgaaagaaattaaaccctaaataaatgtaaagacatcccatgtctttgaatcagaaaattaatattgttaagataatgatagtcccattctgatctatagatcagccttacagattcaacacaatttctgtcataactctcagctgactactttgcacaaatggagtagctgatcctaaagttcatgtggaaatgcaggagacttggattaacaaaaacagtcttgaactaggccgggtacagtgactcatgcctgtaatcccagcactttgggaggctgaggcaggaagatcacttggcctcaggagtttgaggccagcctgggtaacatagtgagacccctgtctctataaaaaatttaaaaattaggcaagcctcgtgacacccacctatagtcccagctactcaagaggctgaggtgggagggtagcttgagcccaggagtttgaggctgcagtaacctgtgattgtgccactgcactccagcctgggtgacagcaagactctgtctcaaaaaaaaaaaacaa

SEQ ID NO: 14150 - DNA, 1218 bp, Homo sapiens
agcacaccaagtatagcaacatacaaggattgtataccatgaccaaatggatttatgcaagtttggttcaacatttgaaaatcagtttatgtaatacactgtgttaatagaataaaggacaaaaaccacatgatcgtttccataggagcaaaaaagcatttgacaaaatccaacaccctttcatggtaaaaacaaaaactcaggagagaacttcctcagcctgttaaagggcatctacaaaaacccatggctgacatacctaatggcaaaaaattgaaagcttctaccactaagatcaggaacaagacgagttcctgatcgtttctggaagtggcagtgccattgccacttctcttcagcatcgtattggaggttctggctagggcagttaggcaagaaaaagaaattaaaggcatgcaaattagaaaagtagtgaaactgttcacagatgggatgatcttatatgtagaaaaatctaaggaatctactataaaaaccagtaaactaataaataggttcaacaaaggttcagaatacaaggctaatattaaaaaatgagtagtatttctatagagtagcaatcaacaaaccaaaaattaagaaaacaattttatttataataggatcaaaaaaataaaatacttaggaacttaagtgtaaaacttatactctgagaattctaaaacatcattgaaagaaattaaaccctaaataaatgtaaagacatcccatgtctttgaatcagaaaattaatattgttaagataatgatagtcccattctgatctatagatcagccttacagattcaacacaatttctgtcataactctcagctgactactttgcacaaatggagtagctgatcctaaagttcatgtggaaatgcaggagacttggattaacaaaaacagtcttgaactaggccgggtacagtgactcatgcctgtaatcccagcactttgggaggctgaggcaggaagatcacttggcctcaggagtttgaggccagcctgggtaacatagtgagacccctgtctctataaaaaatttaaaaattaggcaagcctcgtgacacccacctatagtcccagctactcaagaggctgaggtgggagggtagcttgagcccaggagtttgaggctgcagtaacctgtgattgtgccactgcactccagcctgggtgacagcaagactctgtctcaaaaaaaaaaaacaa

SEQ ID NO: 14151 - DNA, 339 bp, Homo sapiens
acggtctctctctgtcacctaggctacagtgcagtggtgtgatcacagctcattgcagccctgacctcccaggctcagccatccttctacctcagcctcccgagtagctggaaacaggtgcacaccaccacgcccagctaatttttttattttttgtaataaaaagagacaggatcttgctgtgttgcccaagctggtctcaaactcctgcactcaaatgatcttcccgtcttggtcttccaaagtgccggaattacaggcctgagccactgtaccaagccagaatgtgatatatttatactagcggatattattcagcaataaaagggaatgctgata

SEQ ID NO: 14152 - DNA, 339 bp, Homo sapiens; identical to SEQ ID NO: 14151

SEQ ID NO: 14153 - DNA, 844 bp, Homo sapiens
ggttggtctcagatggcctcaggtgatctgcctgccttggcctctcaaagtgctgggattacaggcatgagccaccaccacccagccaaaaaagctggagagactttaaaacaaaaactgttatcagagcaaaatagggatatttgataataacagggtgaaaccatcaagaagatacaacagttataaacatgtatgcatccaaaaacagcccccaaaaaatacatgaagcaaaaactaacagattggaagagagcagtagttcaaaaacaacagctggagaccttaacatactacttttaataatggataaaactaagcagaagatcaacagggaaacagaagacttaaataacactgtataccaacaaggactaacagagaactgtagaaccctccacccaactactacagaatgcacgttcttctcaagtgcacatgaacattctccaggacagaccatatgctaggctgttaaaaaaaagttcagcaaatttaaaaggattaaaactgtacaaaagtatgtcctcaaatcccagtggggtgagttagaaataaataacaaacttgggaaattaataaatacatgcaaattaagcagtatacttctaaataaccagtgggtcaaacaggagatcacaaacaaaattaggaagtgtcttgaggccgggcgcggtggctcacacctgtagtcccagccctttgggaggccgaggaggcgggtcgcttaaggtcaggaggtccaggcaggaaaattgcttgaacccccgaggcagaggttgcagtgagccgagatcacactacagcctgggtgacagagtgagattccatcaaaaaaaaaaaa

SEQ ID NO: 14154 - DNA, 3129 bp, Homo sapiens
ggctgggcgcggtggctcacgcctctaatcccagcactttgggaggccgagatgagtggatcacgaggtcaggagatcgagaccatcctggctaacacggtgtaaacctcgtctctattaaaaataacaaaaaaattagccgggcgtggtggcgggcgcctgtagtcccagctactccggaggctgaggcaggagaatggtgtgaacccgggaggcgaagcttgcagtgagcccagatcgcaccactgcactccagcctgggctacagagcaagactccgtctcaaaaaaaaaaaaaaaaaagataaatagaaggagcccaggtaccttgtgacactggagtgtcatattagccctggactacccacctccagacttgttttatatgacagaaaaataaatccttagtgtttaagccagtataatttggcatttttggttatatgcaactgaatcgaatactaattgataataccatgttgtaatgttaaatataaaaggtaagttgctaagtaaagccagaagaatataaactcaaacgtgtataggtgataggccagtaatacagaaaggtggatgagtggcagtataaatagtagggatgcagaggacatgttgaattggaaagcccctgcaacattaataatattaccatgtggccatgtggattgagatcttccagtttttcatgttaaatttccccagtgttctgcaaacaaaacattttcccagctgtatctacattgcagcctatcagtttgtgacttttgatttgtactatggtctaatatttagaaaaatggaataaaagggagaaggatggaagggagaaaagaaggaagggtggaccagcacttcgggaggctgaggtggctggattatgaggtcaggagtttgagaccagcctggacaatgtggtgaaaccccatctccactaaaaatacaaaaattagctgggcatggtggcatatgcctgtaatcccagctactcgggaggctgaggcaggagaatcgcttgaactcgggaagcggaggttgcagtcagccaagattgtgccactgcactccagcctgggtgacagagcgagactccatctcaaaaaaaaaaaaaaaaagttattgtctgctgtgtgttaaactgggagtctaatgtataaacatgtgaccttgccactttggagaaattccaggaaatggtacaaatggtaccttgattttttttttttcttttttccttttgagacagagtctcttgctctgtcacccaagctggagcgcaatggcacaatcttggctgactgcaacctccaattcccaagttcaagcgattctcctgcctcagccccccgaacagctggtattacaggcatatgccaccccacccagctaatttttgtatttttagtacatacggggtttcaccacgttgtccaagctggtcttgaactcctgacctcatgatccacccaccttggcctcccaaagtgctgggattacaggcatgagccaccgcgcccgccaccttgattattgtttaaataaaagatgaataaaagtacattcttatttttgattataatgtggcccaatgtatacatttcacttagtgtagcacatcacattgttcttactaaaactatttctagttttacaccagctcagatttttaaatattcattgctttttcctacttctgtctcaggcattgccattctcttcaaaacatatttgaaaaatgtccaggcttctcatctctgtgtaaaactgttcagtttgttccagtgtgacgagaagaaattggactgagcatacttttttgtgagacatccattttcttcctttgatgaatttgacaacttgtgacaattctcacattttggaacaagtctcctaattatagaagaagctaataatgataatataagaaattataaattatttgactgttttcaatttatccaaaaggaagtttatcaaactttctcctcctactttctgctccaccccacccctcagccccgatgcacacgctgtgccgtcacagcacttatgcctagagaattatgatccttaaatagcagtcaactcttcttaaatagcagtcagttgttctagcagtgtatcagttagacattctagaatatttcacaaaataagaattttgcagaaggaacattatagctccctaggtctagcaaatgagggaactagggtacagagaaattaagtgacttaagatctcacaacaaactagtggagtacttctacttaaatatatctctagatactcatagaaggtaaaagctacattgaaaattcacacaactcttctggaaagtggcaaattcaatgatgctgtaaagtctggcataatattctagtggtcaagacactttgggtagtaaatgagagaggccaaattcaaatcaggctaagaataaaaagaaatgttttctttcaagtgggtggagctcaagtaagtgtaaattccaggggataaattggattcaggcatagctggatgcaaaggctcaaaaatgtcatcagaatctgcctctttttctctcttggtgttgcttgccactgtgttgtcctcattctcaggtagcttgactcacacagctacaacaatggcttatatcctaatggttgatcagccacagggcagagtacacttttcctcagtggtccaagcaaaaatcctggggctcactcttactggctgacttggatcaggtgtccttctggagcacaacacagtgactccaggtggccaagcttgaatctcatgccacatccctaccaccagctccactaaaaagaaccacatggacagaaggggaggagtggttacaaagggaaaaataaatgtttattacccagggagggataatgaatgtaaggcaagcaaaaacgggaaaaaaaaaagtccattaaaaattcaatttacactatttacactcacattgcactgtaaactgatgcaattaagagtctcatttcttgcttggtggttagggatttatatttcattaaaaaaaatactaccaacattaagtaaggggatacttgaagaaaacaaagatatgcgatgaagaaaactgggctttgcaaaaaaaaaaaaaaaaaa

SEQ ID NO: 14155 - DNA, 2815 bp, Homo sapiens
gagcccaggtaccttgtgacactggagtgtcatattagccctggactacccacctccagacttgttttatatgacagaaaaataaatccttagtgtttaagccagtataatttggcatttttggttatatgcaactgaatcgaatactaattgataataccatgttgtaatgttaaatataaaaggtaagttgctaagtaaagccagaagaatataaactcaaacgtgtataggtgataggccagtaatacagaaaggtggatgagtggcagtataaatagtagggatgcagaggacatgttgaattggaaagcccctgcaacattaataatattaccatgtggccatgtggattgagatcttccagtttttcatgttaaatttccccagtgttctgcaaacaaaacattttcccagctgtatctacattgcagcctatcagtttgtgacttttgatttgtactatggtctaatatttagaaaaatggaataaaagggagaaggatggaagggagaaaagaaggaagggtggaccagcacttcgggaggctgaggtggctggattatgaggtcaggagtttgagaccagcctggacaatgtggtgaaaccccatctccactaaaaatacaaaaattagctgggcatggtggcatatgcctgtaatcccagctactcgggaggctgaggcaggagaatcgcttgaactcgggaagcggaggttgcagtcagccaagattgtgccactgcactccagcctgggtgacagagcgagactccatctcaaaaaaaaaaaaaaaaagttattgtctgctgtgtgttaaactgggagtctaatgtataaacatgtgaccttgccactttggagaaattccaggaaatggtacaaatggtaccttgattttttttttttcttttttccttttgagacagagtctcttgctctgtcacccaagctggagcgcaatggcacaatcttggctgactgcaacctccaattcccaagttcaagcgattctcctgcctcagccccccgaacagctggtattacaggcatatgccaccccacccagctaatttttgtatttttagtacatacggggtttcaccacgttgtccaagctggtcttgaactcctgacctcatgatccacccaccttggcctcccaaagtgctgggattacaggcatgagccaccgcgcccgccaccttgattattgtttaaataaaagatgaataaaagtacattcttatttttgattataatgtggcccaatgtatacatttcacttagtgtagcacatcacattgttcttactaaaactatttctagttttacaccagctcagatttttaaatattcattgctttttcctacttctgtctcaggcattgccattctcttcaaaacatatttgaaaaatgtccaggcttctcatctctgtgtaaaactgttcagtttgttccagtgtgacgagaagaaattggactgagcatacttttttgtgagacatccattttcttcctttgatgaatttgacaacttgtgacaattctcacattttggaacaagtctcctaattatagaagaagctaataatgataatataagaaattataaattatttgactgttttcaatttatccaaaaggaagtttatcaaactttctcctcctactttctgctccaccccacccctcagccccgatgcacacgctgtgccgtcacagcacttatgcctagagaattatgatccttaaatagcagtcaactcttcttaaatagcagtcagttgttctagcagtgtatcagttagacattctagaatatttcacaaaataagaattttgcagaaggaacattatagctccctaggtctagcaaatgagggaactagggtacagagaaattaagtgacttaagatctcacaacaaactagtggagtacttctacttaaatatatctctagatactcatagaaggtaaaagctacattgaaaattcacacaactcttctggaaagtggcaaattcaatgatgctgtaaagtctggcataatattctagtggtcaagacactttgggtagtaaatgagagaggccaaattcaaatcaggctaagaataaaaagaaatgttttctttcaagtgggtggagctcaagtaagtgtaaattccaggggataaattggattcaggcatagctggatgcaaaggctcaaaaatgtcatcagaatctgcctctttttctctcttggtgttgcttgccactgtgttgtcctcattctcaggtagcttgactcacacagctacaacaatggcttatatcctaatggttgatcagccacagggcagagtacacttttcctcagtggtccaagcaaaaatcctggggctcactcttactggctgacttggatcaggtgtccttctggagcacaacacagtgactccaggtggccaagcttgaatctcatgccacatccctaccaccagctccactaaaaagaaccacatggacagaaggggaggagtggttacaaagggaaaaataaatgtttattacccagggagggataatgaatgtaaggcaagcaaaaacgggaaaaaaaaaagtccattaaaaattcaatttacactatttacactcacattgcactgtaaactgatgcaattaagagtctcatttcttgcttggtggttagggatttatatttcattaaaaaaaatactaccaacattaagtaaggggatacttgaagaaaacaaagatatgcgatgaagaaaactgggctttgcaaaaaaaaaaaaaaaaaa

SEQ ID NO: 14156 - DNA, 247 bp, Homo sapiens
gtggatcacgaggtcaggagatcgagaccatcctggctaacacggtgtaaacctcgtctctattaaaaataacaaaaaaattagccgggcgtggtggcgggcgcctgtagtcccagctactccggaggctgaggcaggagaatggtgtgaacccgggaggcgaagcttgcagtgagcccagatcgcaccactgcactccagcctgggctacagagcaagactccgtctcaaaaaaaaaaaaaaaaaa

SEQ ID NO: 14157 - DNA, 2976 bp, Homo sapiens
aaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtaagtatcgtgctctgcttttactttaaaaagaaagaagacaaactttccttcctgtccctgtccttttcgtattatttattcattattcatcatattattattcattatattctcagatgatggaaagtatgtttctggccaaagtcttccacccaaatttggtcccttgtaatgataataagaggggaaagaggtttctgttgataattaattcacttaacaaaatagtacccaggcgaggtactgaaattggccactttcacagcattctggtgatgtctggctgttgatacacaccacacacacacacacacaacactacacacacacacacacacacacacacacacacacacacacactcctttttgcccttaagaggagccctagtcacctggcttgttagacaaggagaaatgatgccactttggtcttcagtttctctgccttgggtactcacaatttcaatcagttgtaattgttgaaagtttcttttcacactacgaaataaatcccatctttcagtgcaggcttgaaacttgcactggcttgggtaaactgtacaaaacactgtagctatagtggacatgtgaatttttattaaatttttcactgcataaccgaaggttctaatattaaagaaacatggacactaactttttaagcacaggcaaaactcaaagccctgttatcaaactatgtgtcttaaagagtgctgaattaacagagtactcttctcagagattatgctcactgctttgagaaactgcttttcaacaagaggtgaatttaaaactctagaataacatgaagaaagacacaacttctgaatacttagcaactctgacttgctatttgaacaagccaaaaaacaaagggtctattttgggcaattgtacaatttgcatttataaaaccgtgattataacttggtatgctatgagatacagagatttattgttttaataagatttcaggtaagaaaactaagaactataaattggtaataatgtagaaaagcaaggcctctcacttttaatgctgtaagtgctgtgattcatttgtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtggagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgggtgacaaagtgagatcctatctcaaaggaaaaaaaaaaaaaaaaagagagagactattgtagtgttccagtgagaactgctgggggcactgagcagtgtaggtggacaatagggcgcagattccagaaatatttagaaggtagaacattcttgactcagggctggatgaagggaatggaggaaaaggaaacttttataatattagttttgggcctgggctactgggtagttgtaatagaataccatagaacaagaggaggtactggtttatgaagaaaattgagttagttggagtaatatcaggttgagatatcactaagaggttagactgcaacgctgagtaaaaataaaaagcaatttttttaagcataaaattatcatctggatgtggtggcatgtgtctgtagtcccagctactcaggaggctgaagcaggaggatctcatgagcccagaggttcaaggctatggtgcactataatcaagcttgtgaatagatactgcactccagcctgagcaacatagtgagaccctggctctttaaaaaaaaaatgctagatttttgtctttgaaattttgaggagatacataaagactgagctctccctactatgttctaatgccccccaagaaatggtcactatctggactcaatgaaatcagagctttaatcttgtgtccctgctgccaaatgaatttttttctcattaacttttcaataggaagcccatgtctagggcagtcttgcctgtagctatgtgtatcctcaaagagagtaatttttacttcttcagagacttcagaaatgagcagagactaaagatctatgagctagtagaatacttattcataaaaagcacatatgcatgaagaagtaatacttatcaaaaacaaaccctttccttaacagggattcttcacttctcttgaacaaggaactcactcagagactaacacaaaggaagtaatttcttacctggtcattatttagtctacaataagttcatccttcttcagtgtgaccagtaaatt

SEQ ID NO: 14158 - DNA, 265 bp, Homo sapiens
cctctaatgtgcagcagcaaaggaacaacagatgccaacattcttgtttgcctcatgaacttaagccctaaagtaagctgacttgagtaaagtttagaggctccccttcaagttttagaaaagctttcttgtttaacttatgcaaatttacacaccctcatgaacctattgcatatatccgacaaccgtccatattttagtaccatgtggtggctctcacctatgcccatatagctggcgacaatgcaggtaagatctggtcagc

SEQ ID NO: 14159 - DNA, 138 bp, Homo sapiens
tcaagcaattctcctgcctcagcctcctgagtagctgggattacaggcacctgccaccacgcctggctaatttttgtatttttagtagagacggggtttcaccatgttggtcaggctgatctcaaactcctgatctca

SEQ ID NO: 14160 - DNA, 480 bp, Homo sapiens
atttttataatactatgctgaatctacaaatggaatactgggtaggttggctgggcacaggagatggctgcacctcctgcagagttaaccttggctgagcaagaggctccagggctgggcaccagatcaacctcatacccctaagtgagggcatcattaatgtctgtggcctgcaagtcgaggcatgcaggcagtcactgggtcaacatctgagcactcctggaccagaaccagtgcattccagaattcttgaattgaggatactaagacagggattcataatgccctctgcttgatgtgctggtggttgccaggaggcttggcttcagattcagaggaagataccaaaaaactgatcgtttccttgaattggcttttctatttacttcgtctgtgtctctcatattgaatatcctaagagagatgctggaatattttggcgttcctctagaagaagttttaccgattggagaaaataaa

SEQ ID NO: 14161 - DNA, 811 bp, Homo sapiens
tgcaccccaacataccgtgtttaactcttctgtcttttgtttttgctgctatttatattttcatttgatatgttttataatgtttgtccctagagttgtcctttattgaatacaagggtcttttctcaattgctataatgtctgttataatccagatgtagatatttgaacaatgtgaatacacatctttatgtgtattatcttaagtgctgtttaatattaaagtgtatttaaaatgaccagatttcaaattagtgcagttttgagatatttgttacttaggtcttaccaggtatgcacctgtgttgtaatttatgttggtatgctttagatctggtgtttccttggttttttgctgccgtatctcaagtggctagatttgatatttccttatccctgatctgacatttttatgtgaccaagtttctgtagcattttgttgaacaccaggtactgttgccactgtgcctaaccctaccatctccactccatgctatctcttactttacatgtaaatgacagttattttagtcacttttcacaatgtgaaatgtttctaggacacttgtccatgaacaggagcaaattgaaatttgaaatgatcacatctgattgacttgtaattagaggatgtttgggtgtggttgaatgtattgtatctgtacttattgaaaaacctgaaagacctggactcactatgttttgttctgcaacctggttagtcagctacgtggaagtgaccagagagttgaaagccaatttatttatccctccaagatgaataaaacataaattactcttctagcaaaaa

SEQ ID NO: 14162 - DNA, 557 bp, Homo sapiens
ataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaa

SEQ ID NO: 14163 - DNA, 113 bp, Homo sapiens
cacgcctgtaatcccagcactttcggaggctgaggcaggcggatcacgaggtcaggagatcgagaccatcctggcctatatggtgaaaccctgtctctactaaaaatacaaaa

SEQ ID NO: 14164 - DNA, 529 bp, Homo sapiens
acaggagaaaaacatatacatttatttaatataagtttatgtggcatgaaaaccttcagaatttgtgaagacccaaagatgcagtttgtattgaccacttatataaggaattagacaaagagcagtaaattgcagaaatgtgatgaggtggggggtcgggggcttgggccagggcaggtgattggaggagaatggctgggaaggaagggccagtatagcaggtggtacaggtttccctcagcctcagcttctggtccttgcccataggaatcatgcctcccacctggccaagggaggacacctttcacatgggaatgtcatctcctgcttttcagaaacagaaggaaggtcagagtgatcttcttgtacctgctttttgtttttgtttttgtttttgtttttgagagagtctctctctgtcacccaggctggagtgcagtggcgcaatctcggctcactgcaacctccgcctcccgggttcaagtgattctcctgcctcagcctcctgaatagctgggattacaggcac

SEQ ID NO: 14165 - DNA, 343 bp, Homo sapiens
ctcgttcataagtaaagttcatgaaagcatataaatatatttaaataataataaacacactgagagaaatgacacaaaaaataattttgaattttctcatgtcattgttactaaagctgagaaaccagatattacataattaacataaagcggtattggaaacaaatgtggagacaagtcttttagattactggcattacatgctgctgactctcgcatcttcatgaaatctgttcccctttgccttctgtgacactggaagcttctgatttaccttcagtctctctgattacatcttctgaattccacttacaggtgcccttttttttttttgcccaacctt

SEQ ID NO: 14166 - DNA, 926 bp, Homo sapiens
tgctttttgaaataacttagacaaataatttcacacaataccagcataaacaagtataaacccgttcacattaatcaggcatccttagggaagattctgatggcctgaatggacatttcaattacatatatgttgatcatgtgtatttttctagtaagcactagtaccttacttgccctcccctgattaaacaaaaactgaaggtataaaacctgcccaaatggaaacctattttttcatagaaaacattgacaattatattttcatgttattctatctctgtttctaatgcatttttctcatattcataacagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataaggtaagaacatactctatcatgttaatgtaatattggaagctccaagtaagataatcggtgtgtgactttaggatattagattagaatatcatatctattgcagagaaagagatttacatattatgtttctacatgtgtgagtgccacatcagtaaatataagtcagtgtttctcaaataggtgctggcataaagatttaatgattaattttgctcatttcattttcaagttaaaatatcgaaagagaaagagaaaacgagagtatcatgaagtctcgtatgatatatatctgtactcctgtgtacataaatgttttctgaaataattttttcctaaagcttcatttttatatatgtaaattttatgtatataatataatctttacatataaataaatataatcatatattc

SEQ ID NO: 14167 - DNA, 163 bp, Homo sapiens
tctcagctcactgcaacctctgcctcccaggttcaagcgattctcccacctcagcctcccgattagctgggactacaggtgcccgccaccacacccggctaatttttgtatttttagtagagatggggtttcactatgttggccaggctggtctcgaactcct

SEQ ID NO: 14168 - DNA, 6584 bp, Homo sapiens
cagattgcttccaagtatgatcatcaggcagaagaagatcttcgcaattggatagaagaggtgacaggcatgagcattggccccaacttccagctgggcttaaaggatggcatcatcctctgcgagtgagttacagccctccagaatctgtttctgctcttccagttctttccacagccttctctctcactctccttctcagcccagggtgtcagaccttgatattctacagatatctttaatgctttcccttactgatgctaaagggagcaacttgatatttcaatccttgtttttgtgtgccagtaaataagatgtctctcatatttttcttttcagacttataaacaagctacagccaggctcagtgaagaaggtcaacgagtcctcactgaactggcctcaggtaacagccaaaccaaccacctctggttctagttggttgcattttatgtagtgaaaacttgatttcaggtttggttttttggttttgtgttttttttttttttaactttttgattacggtttttacatagacattgtagcagaaatttgtgcatatttaattttttgcccttttgtaatggttctgtaattacttatttaactagttctgtaattattatgtttagcttagaagttttcctatatttagtctgtgtacattcagaaaggacttgacacagcttacacagagaaatgcaacccagaccttaaggataagggaaaaaacaaggcattccacataactaacagtggactgcagagcactgtatcagacataaccttagttcatgagtgtgtatgaggaaggaaaatgggatacttactggtcttgaacatgtgtttggagatatgagagaatgagtatttagtaaccacaaatgtattctgaaattaaaataacacataatgaattatttattagtatgagtaattatataccttttgacaaataaaattccaggcctggatagctctgatacagaatccttttaaaatatataaggaagatcttgcccataaaaactgaaaacacgtaactgcttaaaaatattaagactgtgatgtgacccacagtgagagacacactctcttcttgctctttcctgttccagagagagccatgcttagtatgtatttggttgaatccttgtcaaacagctttctgggcagcgtcttataactggttatgaagacttggaattcttagaaattatgaatgtcaatatttagctccagaaattataaaactcttcttctttatagttggagaatattggcaactttattaaagctattcaggcttatggtatgaagccacatgacatattcgaagcaaatgatctttttgagaatggaaacatgacccaggttcagactactctggtggctctagcaggtctggtacgtacatgtctttaatggctggttgacagattcccaccacattggtgatgaattgcatcattgctttttcatgggggttcagaccaggtggggcggggcctgtctcttctgtaattagtagctttgtggaaaggctgctgacatcagctgcatcgtactagatagcttacttagaacactcacatttcaaatgatgcagtatattattgaacagccttaaatactttttatctctagtttgggcccctttgtctatggacatatcatttctttgttgttccttctgtgaaactctgttggccttttcagttagtgtgcatgtttctgtctaggctaaaacaaaaggattccatacaaccattgacattggagttaagtatgcagaaaaacaaacaagacgttttgatgaaggaaaattaaaagctggccaaagtgtaattggtctgcaggtaagtaatgtggtgttgcttattcaattacttattcaatatgattaattctcaccatgcaaaatattaagcctctcctaagaatagatagaagtactatagtactggggggggtgtagtttatacaatttatatctatttataaagcccataagacagtgataattttttagaggaaacctcaggtatgccacctgacttgacaattatttctccaggaaacgaaaatttttaattgaatcatattgtcttttttttttttttttaaaagaaaaatacacttttaaattttttattttatctttttttttttgagacagagtctcactcttttgcccaggctggagtgcagtgacgcgatctcggctcactgtaacctccacctcctgggttcaagcaattctcctgcctcagcctgccaagtagctgggattatgggaatgagccaccatgcccggctaagttttgtagttttagtagagataggatttcaccatgttggccaggctggtcttgaactcctgacctcaggtgatctgcccgcctcggcctcccaaagtgcttggattacaggcgtgaactactgcacctggcctgttttatcttttatatatagatgggatctcactttgttgcccaggatagtctcaaactctggagctcaagcagtcctcctgccttggcctcccgaagtgctgagattacaggcatgagctaccacacccagccagaaatgtactttataaattccttaatgttattgaccaaattaggcaattttacacgaccttaatgccaaagtcacttatttacagtaccaaatcatgatatagcagccaagccctgttagaatttgtcagtttaaattcttctgaaatacgtagttcagatgttttccttctcttcattgttctcttcactggtcatggaaacgtcattgctaattccccaaatgctgttggctttactctccaaaagccactgtacctgcttgatacagtgcccctttctactgagtctatgcaagttagatttatttttacacagtacaaaattgtattggtggtgagaaactggaaacctaaatttcagaacagtagtcagttggttgaattacaactccataaaagcaaagtgtaatgtaaaattatacactagagtttgaaaagataggttatgggggaaaaaaatcagatcatcaaatactgtggtcagtatggatttttaaaattaaaaatgcacatgtttttgtatgtatttgtatatatgtgcatctatagatatatacatagacacataggttaaaaagctaaaaggatattcacaaatgttgacagtgaatggatggtggtatcacaatgatttttcccccctcctttttgcttatatgtgttttctgaattttcttcaatgaacagattttatattagtaataaagattttctttaatcttatttttaaagaaaaaatatccaacatcagaaaagtgtgcctaaccagtggaacagggtgtaatggttggtcctgaagccatactgttctcagtggggaagaaaaattaattattgtttccctgaactttgctgagttcaaattcctcattccacctttctccagctctgtccaaggacatgggagttacaggaataaaatgtggttcctttctggagaaaatgttggtgattttgaaactttaaaaagcccttgttaagctcccagagaaaacacttggcatttgctttcacattttatgtaaaacattcctggagtagaacagcatattgcttggcctaggattacttctgttgaaataaccgaagctggtacctcttaatttggttatctggggaaagagtagcagaggaaattattctgccactgtaatgacttttggtgtgtcagtccacctgttaaagtgtgtttaattcttctatgtatgagtttttatctatagtgactttaaattttctttttaaagttagcacttgaaatttgtttgtagacacatagaagagttgactggagcctcagctcagtaacttgtcggttgtgccccttctgtctttttggtagcatggaaagttttgtttgtgttgtgtatattgttgacatctgataatttgtgcaattttatttttaacttaaaagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgatta

SEQ ID NO: 14169 - DNA, 2582 bp, Homo sapiens
ggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttcttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacagctgattatttt

SEQ ID NO: 14170 - DNA, 2579 bp, Homo sapiens
ggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgatta

SEQ ID NO: 14171 - DNA, 4114 bp, Homo sapiens
tccttatcttaaaaaggtttatttattagttgtgcacttacaaacttacctcagttcttacatagtgtactttgtaagttgatgcatataaacatggttttagaagagtttttctgtcctaatttgtacaaaaaaaggtaaactaatatagttccagtattgttacctggtcaaacaataatgacaaagacaatgaggaagaatagggtttattaggtcttttaaaaaaaaattcactaacttttctctagtggtctcatcttctattctgtaaatggctcttagaaggaaatgttttccaggtacagatacctaaatgggtatctatctcacaatggcctggagttctgttccctcctcattccttaatgagtgcttgtcctgctgtgcccttgcattgtttaatttgttgctcctttttacgaaactctgaaaaacaaaagaacaagttagaatagtattatgtgtctgtactgttgataacgtaggggccgagggaaaacttctcctttgccctctgacggtttgctgaagaattaacttacaaaaggcagattaacaggagaaatggcatataaagtagcacaggggagaatcacagtgagtgtctaaatggggtacagataattctgtttttgggaaagggagatggggaagtgtggatgattttatgggggtggtgaattacttttaggggagtttaatgagcttgaagaacacttagtggctgggaacaaagtctgttgggcccacaggacagtggtttgtgacaaaagtctgtccaggtgtgttgactgaatttagtctttgtttctgctatataagtccagttaatggaaaactcagggaaggggccagaggtggtttttttctttggtgggtctggactttaggcagataaggggatttcattcagatgacagcttcatcctgtgctttgggagaaggtcagagagttcttgaggcttcttcagttcagcatgtcaaagtgccatattatggagtatcaatttctgagtcccaatgatagccatttacaagttcttggccttaaatttcagataactggatccttaagaaagtttcttctgttgaaaaaactattttaaggggtaaatttcaaggtggattttttttgggggggaggtggtggagacggagtcaccctctgtcgcccaggctggagtgcaatggcgccatctcagctcactgcaacctccacctcccgggttcaagcgattctcctgtctcagcctcctaagcagctgagattacaggcgcctgccactgtgcctggctaatttttgtatttttagtagagatagggtttcaccatgttggccaggctggtctcaaattcctgacctcatgtgatccacctgccttggcttcccaaagtgctgggattgcaggtgtgagccatagtgcccggatttcaaggtggatttttaactggaaaagtaaatcaggggatggagacctggctagctacataccaccatcataagcactttccttagagtacatacaaataagtcaataaacaagtaaaaagtaaaaattgtattttggctgagtgcggtggctcacaactgtaatcccagcacttgtgggaggccgaggcagatggatcacctgaggtcaggagttcaaaaccagcctgaccaacatggtgaaaccccgtctcttctaaaaatacaaaattaggcgtggtggtgcacgcctgtaatcccagctacttgggaggctgaggcaggagaatcgcttgaacctaggaggtggaggttgcggtgagctgagattgcgccattgcactcaagcctgggcaacaagagcaaaactctgtctcaaaaaaaaaagtaaaatttgtagtttatgttttatatggagaaggatgaggatacattaattataaattgtagaagtggttcttaaaaaattgagtgcctgctgaaccaaagagtgcattaaatgctctgtttaaagctaaaagggctttaacacctaatttttatggcaacagaatgaaagaaaagtatgcaaatatcatataactcagacaaggaaaagagatgagacatcattcagctgttaaaatatccctgtctacccaggataaggcaaataagcaacaactgtgttgcaaaggctgttgcaaacagctgcctgctatttccagatataagcagtatgggcgctccgctgagggtgtggcttttctcacactggtgtgcctgggctaataaagggcctgagaattgcagatctgtcaatactggcacagaggagcacacaagtgtgctctccctaatatagtgggtatgaacatcatgcttggagatgcaaaaatgctttagaaaaagatcaactgttaaacttctagaccacccaaaaggccagatcatgccatgagcaccaaagggagctgaactactgtgttcaggacatcttctgcccagggtaagaagtgctgctgctacttaggaatccatctgatcagcattcttgttcagcttcacttcttcagggagaaggttctcagaaagggaggtgggttcagccttggagagttcagcgcaaatcccactttcaggcccgggggtagtagaagcctcagagccctctagaagagagaggctgggtatgagcctctttcgtgtgtgcagctttacaaaactttcaagattgcgagcatggagattgcaactggaaatgaaatgtttgcttaccagaaattcttgatccataaagtagggcttttctgacgatccatcatttgtttccagatcaacagcaaaacacaggaaaagtgcatccagcacagtttcaaacacagataaaaaactatgggctactaagtaggcaaaaaaagctaccaataacagagggactgcccacacctggaatgcccgattgtagttaaaagccatgagtcctccaaaaacagtgaaacacaccactaacacctgtgcaaaagaagagtttgttgaaaatctttatgaatcagttgcttagatgtttttgtcagttacaagtaatggtttaatatacgttcctgtgtgcaacgtgtgtgtgcactattgtaaagaatgcttgtcagaaattttggcagaatgaaatagaggaaaaaatgaaaagctgtatcaaaaggaaacccagttaatggcgagtaggaaggttatatgtaattttatctgtgcctagcttttgtatttatataaatgtaataatatctcacaagctttttattctgctttttcacttaacaccaaaataagcctattcactttaaaactttttttagaaaccatccctctttcttttgagacagagtctcgttctgttgcccaggctggagtacagtggtgtgatctcggctcactgcaacctccgcctcccaggttcaagtgattctcctgcctcagcctcctgagtagctgggattacaggcacccgccaccacacccggctaatttttgtatttttagtagagacggggttttcccatgttggccaggctgatctcaaactcctgacctcaagtgatctgcctgcctcggtatcccaaaatactgggattacacatgtgagccactgtgcccagtccaggtttcaatactctttccatatattcttaatgagaaacccacaaacgttcattttctgagattagtagcattttcattttagacctgaaaaagagggaatcagaatggtagaactgatcacaggtaagagagtaagactaagattaaaattctggctctacctattgtagtaccctggaaaggttattaaaccttcattttctcttctgcaaagtagggatacctcatgggattgaggattaaatgagataatgaagcacagcacccactatagagtaagtactcaagaaatatagttccctttcaaaccaattgttgtatggcttaattttcagaatcccaggctcctttatttagtcaagatatctcacctttcctagaaaaattatgaagtctccaaagcagttaatagatgtaaagtgacttgagttcttggacaagattttgaatgcatcttttgctgatgtacagaaatctgtcccattaatagcagttgtagtatatgc

SEQ ID NO: 14172 - DNA, 240 bp, Homo sapiens
tcacatgtttgggtgtcaggttcaattctagatactaagaatctgaatgaactagatgcttttcctgcctgtaagaagtctaataggatagagactacataaacagaatttaaatattgtacagtaattagtactgaggaaagtgtgtgtgtgtgtgtttagtatatagtgtgtatttggctgaatagaaggcaaataccagaactttccagtcaacaaaactattggaatgttatgtat

SEQ ID NO: 14173 - DNA, 1115 bp, Homo sapiens
tccttatcttaaaaaggtttatttattagttgtgcacttacaaacttacctcagttcttacatagtgtactttgtaagttgatgcatataaacatggttttagaagagtttttctgtcctaatttgtacaaaaaaaggtaaactaatatagttccagtattgttacctggtcaaacaataatgacaaagacaatgaggaagaatagggtttattaggtcttttaaaaaaaaattcactaacttttctctagtggtctcatcttctattctgtaaatggctcttagaaggaaatgttttccaggtacagatacctaaatgggtatctatctcacaatggcctggagttctgttccctcctcattccttaatgagtgcttgtcctgctgtgcccttgcattgtttaatttgttgctcctttttacgaaactctgaaaaacaaaagaacaagttagaatagtattatgtgtctgtactgttgataacgtaggggccgagggaaaacttctcctttgccctctgacggtttgctgaagaattaacttacaaaaggcagattaacaggagaaatggcatataaagtagcacaggggagaatcacagtgagtgtctaaatggggtacagataattctgtttttgggaaagggagatggggaagtgtggatgattttatgggggtggtgaattacttttaggggagtttaatgagcttgaagaacacttagtggctgggaacaaagtctgttgggcccacaggacagtggtttgtgacaaaagtctgtccaggtgtgttgactgaatttagtctttgtttctgctatataagtccagttaatggaaaactcagggaaggggccagaggtggtttttttctttggtgggtctggactttaggcagataaggggatttcattcagatgacagcttcatcctgtgctttgggagaaggtcagagagttcttgaggcttcttcagttcagcatgtcaaagtgccatattatggagtatcaatttctgagtcccaatgatagccatttacaagttcttggccttaaatttcagataactggatccttaagaaagtttcttctgttgaaaaaactattttaaggggta

SEQ ID NO: 14174 - DNA, 1115 bp, Homo sapiens; identical to SEQ ID NO: 14173

SEQ ID NO: 14175 - DNA, 779 bp, Homo sapiens
ttttgttttaatctttgggggtaaaataatgcaataatgataaaacaaaattcaaaagcctgtaaagctatgggatctgcttgggattttcaagggtgagatagggtctataatagacatgtgtttactgattgtgaccccaggcattggttttctgtccttcattgttaggataggtggatctggggacacagactgagtggagtggagaagaaaggatttattaataatcagggaggagcatgtgggatagatctgaggtatctgcaagcatttgagaactactgattgtaactatatgaactgaagatggctcagtgcaatcctgggtctttccacattccatatttaattaaaggcctttgccatatcttggttcctggctcaattttagtcagataaaatttaagttattataaaataataacaaatttggcatataaggttttaaactgatcacggtagctggacagcattagcaacaatagttgaaaaaatagagcttctttatgcagtgatatctgtataatctatttagctcaaagataacattgagtttatatccacgtatgtttatgaatgtgtaatttggacacctgggattttattgtatgtagatgttttatccgttccctttttaaaatccaatgttctatctgtaatgctctgccactacacattctttcaaaaaaattctgattctaaatctttaatgatgatatgcctcaatcttcttttaacatagatagctcttctggaaaaaaaacaaaaaaacaaaa

SEQ ID NO: 14176 - DNA, 3562 bp, Homo sapiens
  misc_feature (3379)..(3379): n equals a,t,g, or c
gaaatcgcaggactacaagtccctcaatgccacttgcgccggaggcacttccttttccggttgtgctaggcgcctgctcctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttattgggaaagttcttctgccgaacccgtgccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctagtgatgcccaggggcaggttatagccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccttctgcctggctgttctgagccagataggcctcccagaaggcattgagccaatgcttttctcctcagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagagtgtggacgcaggcatcccatggctgtacatttacattcttagaagtcagaccccagtgacttggagaggctgctgggaagtcagctggctgaaaaggggtcaagatccagggcttaaaacttgctgcagacaatccaccaaacaggccagtaggaatcagctctggtggctcatcctcagaggtgtgtgctcaatagcccttgccccangagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcagt

SEQ ID NO: 14177 - DNA, 3564 bp, Homo sapiens
gaaatcgcaggactacaagtccctcaatgccacttgcgccggaggcacttccttttccggttgtgctaggcgcctgctcctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctagtgatgcccaggggcaggttatagccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccctctgcctggctgctctgagccagataggcctcccagaaggcattgagccaatgcttttctcctcagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcagt

SEQ ID NO: 14178 - DNA, 3564 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctggtgatgcccaggggcaggttatggccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccctctgcctggctgctctgagccagataggcctcccagaaggcattgagccaatgcttttctcctcagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcagt

SEQ ID NO: 14179 - DNA, 3481 bp, Homo sapiens
ctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggtatgagatctctagacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctagtgatgcccaggggcaggttatagccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccctctgcctggctgctctgagccagataggcctcccagaaggcattgagccaatgcttttctcctcagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagca

SEQ ID NO: 14180 - DNA, 3483 bp, Homo sapiens
ctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaataccaaaattagatgtggtggtgcgcacctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctagtgatgcccaggggcaggttatagccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccctctgcctggctgctctgagccagataggcctcccagaaggcattgagccaatgcttttctcctcagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagca

SEQ ID NO: 14181 - DNA, 6927 bp, Homo sapiens
  misc_feature (2329)..(2329): n equals a,t,g, or c
tcagatacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcgcagtgactacaggaacaaacgccaaaggagagagatgtagggtgggatgacctgctgaaccccagggcagggacagggccaagacactcacaccattgccagccgggcagtggcagcttccagcaggtggcccacttactttccgtgaagcctgtttaccacaggcttaaggcaactttggtccaaggttgaccccctcaagcagcttggatccccagcctgtccccaactcctgcactgaggaacccctccccaggcttggaaacagagccagctgctaacggttttggggctgtgctgtgtccagatgggctccatggggcagtggacggtcactttccagttaaggactgagggcccgcagtccaagaacatgaacccccattgaggaagcccaggaatcctattacatggagtggggctcggcagttttaaggcatagggaggattcccccagtgggagggagaacaaagtcatcataaggaaggctcagcccctgcatggtttgggaatcgtaaaattcctatgtcaacggaaccaaattggggagggggctgggagcaagctatccctgctattcctgcatccccgtgctcttccctatcctgaggacaagtgctttgagatcaatggcaaaagggggcctgcagttcataggcttcaaggaaaggcctccactatagaaaggcctcccattcaaagctgagaatgagtggtgggacaggggcaaggcctgcttcccaaagaggtggcagcataccacagggcaaggacagcaattccctttcccatttctggacccatggcagacatggctaaatgaatactacactccttccatgagcctggatgtagcctcggaatgcaccaggcaccactaagaaacttgaaggtggcacttaagatacaacttcttccctaacccagggtcttggtggttgggagtgggatgggtgtcggaggctccctgggagggatcagagtcagagccctgtctttgcaagtgtcacacccctgctctggcccactctgagctttctagctccatccttccattccttcctgccctggtttaagtgcatttagtaattacttcattaataacagcaaaagctatttgcatctgcccaccagccaagaccaggctgctgcttgagggattcctgctcctctgctcagagagaatgatgtggtcactgatcactgtgagctccagacgctcccaggaacgcaggcagtgaagctgcaataccatctgggggctcaaagggaatttcctcttcctggatattcctggttcaaggctctagggcttacctggcccactggcccctactggttcaggcctgtgaagggctgagggtggcttcaccaggcactgagtagacttaaggcacaaagtcagtttctccaacccaggcagggctggcctcggctgccctgggacttcttgggagccaagccctcccagggagaagaaacctcctgggccacacttaaagcttagaagtccgagtctggcgtaacaggcaaaccccagaaagtccactaccaagccatcccccagggaacagctttaagggggagagccgtctgccctccattgactcatgggggtccacccaagtctcttagggctggatccgagccccctgctgatctcaaaggtgggcaggtcctctctccaaaagggttggctccagtctcaaaaggggaggcaagggagaatgggttgtgaacaaatcagggccacaggcttccccttccttccagggcacctgaaccagccctccaaccaccatatttggaaagaggtaaactggtcctgtcctggcccctagggggtggcaggcaggaaggcccaagaagtctctggctctcaggttccttctgagccgtgaggggcgaccagctggaacagcaactccagtgtgaagacttccagtttcaccagtctcgggtagggccagtgaacagcagagctggcctgcagcgggctccagtgtaacaccattgcatccagtgttggggggtgcntgggcacccctggtccctggtgtggtgctgcctcaggagggcagctcagtcacacaggcggtagaagtggaagtggtagtctgtggctggctgggcgagagcctctgaactgcagttggcctgaccctgggtggaaggcagtgggaaggtgaggtggctctgggggtgcggggcagatggcactccctgctgacattgcttgacactgtgcccccagccctaccacatactgtgcaaaccccccattcctcaagccccacgtcgcagacaggggtgcccagacctccagggtaggtgggatgcccctgctcaccagcagtgccacccggaagtggtaggtgaattcacggaaggacaggatggttattggccaccggtgagaggtgccctggagagaagggagagaggggtcaggacagactgctgcccttatcccaaccagcatctctcaccacggccgtcgcagtcctggggtctgtggggagttttatgaaggaaaaaagcagagaactttgaagagataggaaggagcatgttctgctttggcagaaggagcaatggcagctactccatgcagaccgtgcccgggactggcaggtccacagccacctccacgtgggccctgcctccttcccagtcctgttgtggtgggttcctcacccactatgctctgggcacatcaaagtatttcattagccccatcctcagtacaatccagtgacacagtgctgctactagccccatcttctggatgaggaaactgagccacttcctaaaaatcacacagtgtggcaaaatcacacagctgggattcaaacccaggtctgtctggctgtctccctcacagggtggcatgcagcctggctgcaggcagcttgcccatctacctgaggctttggctgtgcgtctgtgatgtggtttcaggcccgagcaccatgtctgctgtgtgtctagctgggctctccctctgtcttggaccctgtctcttctgcagggcgacagggctcgggcctccctcagaagcacccccacctctgttgcaggtgctttctgcacgtcttttctccctcactatagagtacgttcttggaagtcaaaacctgtgtctactccacctctctcccctgcagctaggcccacccagcacagggcctgggacagatggggccccaatcaatattttctgagtaaacacatgaatgggcaagaaaaaataatcactacttcccttcatttgtcctgagcgtcttctcccatggcctcttaggctcaagaagaaactgggggtccatcagccccagggacagtcataacttccggttacctggccagggaggagctcaccatccagttctcccagaagaggtggccaaacatggaacctgaggggccctctgatgctgtacatctagctgtgccacttccccaacctgagcatgaggtcggctccttcctgcttctgcagacacctccagtgagccacagccctccccgccatgggctcccagacacctgcctgtttccatcattgcactcatccacattagcacctgtgatctgctgtcttccccacgtctccagcacggcagggctgggagatgctcagcagagtgcaatgaacaaacacgggcacgcgtgcccctccctgggacacagaggcccaggccccagagtgtcccttgtggagaaggctttactctataactcccagcttctgctccttgcccattttggggcccagttgtgccaggagagaagcagctcgggcctggccggcccgcagcttcccagtcccacctacctgggtgtcctggtgggtgtggagactctgtggaaggctcccctcctcacatggttcctcctttgacctcaggctgcacagcaccacagacacgggggaggaggagctgtagacaggcccagttagcagagaaatgaggttctagagtccctcaaccccagccccctcccagccagcctgccacacgcctctgaatctccacccagcctgaaacaccgcataataaccagggccctcgaacaaaacctttcccatcgaccatcccatgtggtcctcagcccatgaggccaggtcatttagccagttaaccacgaagtaggcaatgaagtcagcacttatcccaccatgcaggaaataccagagactctccggctgtcctcagactcggctgttctgaagctctgcgggagattctccctggctcctctcctgcctcccacttccccacaccggcactcactttatttgcagagtcaggctgaggtgcagtggggtgccactactgacagggatgtggtaggtgaagttcccaggcctgcaggggcaaaactggcaccttagcctgagggtaccgtgccaccccccacccccaccagggactcctcagcccccaatctgtactggagccctccagaagagacagtgtccaagggtagcctggaaaggggctacccttccttatgggggaggctcctccctgaaagggcaagttccgggtgatctgtaccacctgggctcatgtcacctgaggacctccctgggtgaggggagggagcccagcccacctgcaggcatcccctggagcacagtactgggaggtgatggacatcgaattctccagcacctggatggaggtcagggagggcactggctctgcaaggagagaggctgttggggcaggagtaaggtgacaaggcaggacacaaatgagaagctggcaagtctttccttgccagacttgaagcagtcactcacaccttagtatgaataagttccaggttatttttttccagacctccacaatggccagcatcacactacaccctttcctcagcagccctaggactacccagttcccatgagcctgacgtctgcctcctcaaaagaactggaacacccagaagtagggatgggtcttcacatcccctgccaggtgtgcaggagcccgctcgaggcctgtgttcctgactgcgggcatctctcccagttctgggttcagaaacatcagttacactggtagcttgaaatcagcagtgttgacagcatcacacaaatcaggctcccctctgccccgaggccgatgattacaccgctaccagcacgctgctcctcgcagcctccctgaacaaaccgactgcaggctggctggctgggtaggggtgggactgaagtgtgacaagtcagatgggggagacaggacttcttgctcatctagttcacatacagtcttgctgctgcctgactatccacccaggaagggggaagctggggccgctgaacatttgctggacctggtacgttttcagctctgaggcatgacccagggacccaaggaccccaacaggatccaggacaccctgtgtggtcaggacaggtatcagatacagacgagatggaaggtgcccttcccacatcccttctgggcaaattccaaaggtcctttaaagagtcagctcaaatgtcaccaactccagagaagttttccctgatcctccccaccttcgtccggattaagtgtcctccccagtcccaaagctacctgcatgtcccctcagagcctcatcacactgctgtgttttcatctctgtgaggtctttggggacaggggcgtgtccatcttcatcacccccagtcccctgtacagagccagccacagagtggcaggcagctcagtaaacaggtgcctggcaaacatctcccccatggggttcccccatcacattgaatttccatctctgtaagccacattttccaggctttctttttcttgaagccacaaaatccatcagatgaaagttggtgagagcagagctgcctggttgaagccaggaagcctcccagcctccccttcaacccccagggcagcccccagcgcagcccccagggtacctcagaggaacccagtttgaaaactacaataaaaggttctgtagctttgttaaaaccaaagatccaaggtttgggaaatagtaggggagacccagtatagcaccctcctggtgctggcatggcgaaggaggagccaggctcgggatcaaatacaagccctgcctcggaggggctgtataaccctgggcaggtcacttcaccttagtctccatcccatttcttcagctgaacaataggaacaacaattcctttcttgcaggagtgctgtgaggactaaatgggatgatctatgtaaggctgcaggcctgattcctgatccttattctgtgctcagcaaacgtctattgactgacaagtctgaacccagacagtcacatgactgggctgaggtgggccctggccagtgagccttgccaggctgggctgggtagtgtcaggggtgcagcaagtacctgactggccctgggcccaggtgggctcagcagggcccacgctggactggagggcccctcggcgggcccggccatggaaaccaaggctgggactgttcttggctttgccctgccccccagggaaggggactgcagggctggccagaggctccagactcttgtgatgcttggagtggccaatgccattgactgaaagaccccaggacttggctctgatgttggtgactggcagaagg

SEQ ID NO: 14182 - DNA, 4442 bp, Homo sapiens
acattttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtctcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctctgatgtcattctcccggatggcactgggggccacatcagcaattagtttggccaggccttgaattcccatggcaacacagaggagggatgactaaaaaggaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggacccgttcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaac

SEQ ID NO: 14183 - DNA, 4443 bp, Homo sapiens; identical to SEQ ID NO: 11329

SEQ ID NO: 14184 - DNA, 6930 bp, Homo sapiens
tcagatacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcccagtgactacaggaacaaacgccaaaggagagagaagaagggagggatgacctgctggaccccagggcagggacagggccaagacactcacaccattgccagccgggcagctggcagcttccagcaggtggcccacttaccttccctgaagcccttttaccacaggcttaaggcaactttggtccaaggttgaccccctcaagcagcttggatccccagcctgtccccaactcctgcactgaggaacccctccccaggcttggaaacagagccagctgctaacggttttggggctgtgctgtgtccagatgggctccatggggcagtggacggtcactttccagttaaggactgagggcccgcagtccaagaacatgaacccccattgaggaagcccaggaatcctattacatggagtggggctcggcagttttaaggcatagggaggattcccccagtgggagggagaacaaagtcatcataaggaaggctcagcccctgcatggtttgggaatcgtaaaattcctatgtcaacggaaccaaattggggagggggctgggagcaagctatccctgctattcctgcatccccctgctcttccctatcctgaggacaagtgctttgagatcaatggcaaaagggggcctgcagttcataggcttcaaggaaaggcctccactatagaaaggcctcccattcaaagctgagaatgagtggtgggacaggggcaaggcctgcttcccaaagaggtggcagcataccacagggcaaggacagcaattccctttcccatttctggacccatggcagacatggctaaatgaatactacactccttccatgagcctggatgtagcctcggaatgcaccaggcaccactaagaaacttgaaggtggcacttaagatacaacttcttccctaacccagggtcttggtggttgggagtgggatgggtgtcggaggctccctgggagggatcagagtcagagccctgtctttgcaagtgtcacacccctgctctggcccactctgagctttctagctccatccttccattccttcctgccctggtttaagtgcatttagtaattacttcattaataacagcaaaagctatttgcatctgcccaccagccaagaccaggctgctgcttgagggattcctgctcctctgctcagagagaatgatgtggtcactgatcactgtgagctccagacgctcccaggaacgcaggcagtgaagctgcaataccatctgggggctcaaagggaatttcctcttcctggatattcctggttcaaggctctagggcttacctggcccactggcccctactggttcaggcctgtgaagggctgagggtggcttcaccaggcactgagtagacttaaggcacaaagtcagtttctccaacccaggcagggctggcctcggctgccctgggacttcttgggagccaagccctcccagggagaagaaacctcctgggccacacttaaagcttagaagtccgagtctggcgtaacaggcaaaccccagaaagtccactaccaagccatcccccagggaacagctttaagggggagagccgtctgccctccattgactcatgggggtccacccaagtctcttagggctggatccgagccccctgctgatctcaaaggtgggcaggtcctctctccaaaagggttggctccagtctcaaaaggggaggcaagggagaatgggctctgaacaaatcagggccacaggcttccccttccctccagggcacctgaaccagccctccaaccaccatatctggaaagaggtaaactggtcctgtcctggcccctagggggtggcaggcaggaaggcccaagaagtctctggctctcaggttccctctgtgccgtgaggggcgaccagctggaacagcaactccagtgtgaagacttccagtttcaccagtctcgggtagggccagtgaacagcagagctggcctgcagcgggctccagtgtaacaccattgcatccagtgttggggggtgcctgggcacccctggtccctggtgtggtgctgcctcaggagggcagctcagtcacacaggcggtagaagtggaagtggtagtctgtggctggctgggcgagagcctctgaactgcagttggcctgaccctgggtggaagggcagtgggaaggtgaggtggctctgggggtgcggggcagatggcactccctgctgacattgcttgacactgtgcccccagccctaccacatactgtgcaaaccccccattcctcaagccccacgtcgcagacaggggtgcccagacctccagggtaggtgggatgcccctgctcaccagcagtgccacccggaagtggtaggtgaattcacggaaggacaggatggttattggccaccggtgagaggtgccctggagagaagggagagaggggtcaggacagactgctgcccttatcccaaccagcatctctcaccacggccgtcgcagtcctggggtctgtggggagttttatgaaggaaaaaagcagagaactttgaagagataggaaggagcatgttctgctttggcagaaggagcaatggcagctactccatgcagaccgtgcccgggactggcaggtccacagccacctccacctggcccctgcctccttcccagtcctgttgtgctgggttccctcacccactatgctctgggcacatcaaagtatttcattagccccatcctcagtacaatccagtgacacagtgctgctactagccccatcttctggatgaggaaactgagccacttcctaaaaatcacacagtgtggcaaaatcacacagctgggattcaaacccaggtctgtctggctgtctccctcacagggtggcatgcagcctggctgcaggcagcttgcccatctacctgaggctttggctgtgcgtctgtgatgtggtttcaggcccgagcaccatgtctgctgtgtgtctagctgggctctccctctgtcttggaccctgtctcttctgcagggcgacagggctcgggcctccctcagaagcacccccacctctgttgcaggtgctttctgcacgtcttttctccctcactatagagtacgttcttggaagtcaaaacctgtgtctactccacctctctcccctgcagctaggcccacccagcacagggcctgggacagatggggccccaatcaatattttctgagtaaacacatgaatgggcaagaaaaaataatcactacttcccttcatttgtcctgagcgtcttctcccatggcctcttaggctcaagaagaaactgggggtccatcagccccagggacagtcataacttccggttacctggccagggaggagctcaccatccagttctcccagaagaggtggccaaacatggaacctgaggggccctctgatgctgtacatctagctgtgccacttccccaacctgagcatgaggtcggctccttcctgcttctgcagacacctccagtgagccacagccctccccgccatgggctcccagacacctgcctgtttccatcattgcactcatccacattagcacctgtgatctgctgtcttccccacgtctccagcacggcagggctgggagatgctcagcagagtgcaatgaacaaacacgggcacgcgtgcccctccctgggacacagaggcccaggccccagagtgtcccttgtggagaaggctttactctataactcccagcttctgctccttgcccattttggggcccagttgtgccaggagagaagcagctcgggcctggccggcccgcagcttcccagtcccacctacctgggtgtcctggtgggtgtggagactctgtggaaggctcccctcctcacatggttcctcctttgacctcaggctgcacagcaccacagacacgggggaggaggagctgtagacaggcccagttagcagagaaatgaggttctagagtccctcaaccccagccccctcccagccagcctgccacacgcctctgaatctccacccagcctgaaacaccgcataataaccagggccctcgaacaaaacctttcccatcgaccatcccatgtggtcctcagcccatgaggccaggtcatttagccagttaaccacgaagtaggcaatgaagtcagcacttatcccaccatgcaggaaataccagagactctccggctgtcctcagactcggctgttctgaggctctgcgggagattctccctggctcccctcctgcctcccacttccccacaccggcactcacttcatctgcagagtcaggctgaggtgcagtggggtgccactactgacagggatgtggtaggtgaagttcccaggcctgcaggggcaaaactggcaccttagcctgagggtaccctgccaccccccacccccaccagggactcctcagcccccaatctgtactggagccctccagaagagacagtgtccaagggtagcctggaaaggggctacccttccttatgggggaggctcctccctgaaagggcaagttccgggtgatctgtaccacctgggctcatgtcacctgaggacctccctgggtgaggggagggagcccagcccacctgcaggcatcccctggagcacagtactgggaggtgatggacatcgaattctccagcacctggatggaggtcagggagggcactggctctgcaaggagagaggctgttggggcaggagtaaggtgacaaggcaggacacaaatgagaagctggcaagtctttccttgccagacttgaagcagtcactcacaccttagtatgaataagttccaggttatttttttccagacctccacaatggccagcatcacactacaccctttcctcagcagccctaggactacccagttcccatgagcctgacgtctgcctcctcaaaagaactggaacacccagaagtagggatgggtcttcacatcccctgccaggtgtgcaggagcccgctcgaggcctgtgttcctgactgcgggcatctctcccagttctgggttcagaaacatcagttacactggtagcttgaaatcagcagtgttgacagcatcacacaaatcaggctcccctctgccccgaggccgatgattacaccgctaccagcacgctgctcctcgcagcctccctgaacaaaccgactgcaggctggctggctgggtaggggtgggactgaagtgtgacaagtcagatgggggagacaggacttcttgctcatctagttcacatacagtcttgctgctgcctgactatccacccaggaagggggaagctggggccgctgaacatttgctggacctggtacgttttcagctctgaggcatgacccagggacccaaggaccccaacaggatccaggacaccctgtgtggtcaggacaggtatcagatacagacgagatggaaggtgcccttcccacatcccttctgggcaaattccaaaggtcctttaaagagtcagctcaaatgtcaccaactccagagaagttttccctgatcctccccaccttcgtccggattaagtgtcctccccagtcccaaagctacctgcatgtcccctcagagcctcatcacactgctgtgttttcatctctgtgaggtctttggggacaggggcgtgtccatcttcatcacccccagtcccctgtacagagccagccacagagtggcaggcagctcagtaaacaggtgcctggcaaacatctcccccatggggttcccccatcacattgaatttccatctctgtaagccacattttccaggctttctttttcttgaagccacaaaatccatcagatgaaagttggtgagagcagagctgcctggttgaagccaggaagcctcccagcctccccttcaacccccagggcagcccccagcgcagcccccagggtacctcagaggaacccagtttgaaaactacaataaaaggttctgtagctttgttaaaaccaaagatccaaggtttgggaaatagtaggggagacccagtatagcaccctcctggtgctggcatggcgaaggaggagccaggctcgggatcaaatacaagccctgcctcggaggggctgtataaccctgggcaggtcacttcaccttagtctccatcccatttcttcagctgaacaataggaacaacaattcctttcttgcaggagtgctgtgaggactaaatgggatgatctatgtaaggctgcaggcctgattcctgatccttattctgtgctcagcaaacgtctattgactgacaagtctgaacccagacagtcacatgactgggctgaggtgggccctggccagtgagccttgccaggctgggctgggtagtgtcaggggtgcagcaagtacctgactggccctgggcccaggtgggctcagcagggcccacgctggactggagggcccctcggcgggcccggccatggaaaccaaggctgggactgttcttggctttgccctgccccccagggaaggggactgcagggctggccagaggctccagactcttgtgatgcttggagtggccaatgccattgactgaaagaccccaggacttggctctgatgttggtgactggcagaagg

SEQ ID NO: 14185 - DNA, 6930 bp, Homo sapiens
tcagatacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcccagtgactacaggaacaaacgccaaaggagagagaagaagggagggatgacctgctggaccccagggcagggacagggccaagacactcacaccattgccagccgggcagctggcagcttccagcaggtggcccacttaccttccctgaagcccttttaccacaggcttaaggcaactttggtccaaggttgaccccctcaagcagcttggatccccagcctgtccccaactcctgcactgaggaacccctccccaggcttggaaacagagccagctgctaacggttttggggctgtgctgtgtccagatgggctccatggggcagtggacggtcactttccagttaaggactgagggcccgcagtccaagaacatgaacccccattgaggaagcccaggaatcctattacatggagtggggctcggcagttttaaggcatagggaggattcccccagtgggagggagaacaaagtcatcataaggaaggctcagcccctgcatggtttgggaatcgtaaaattcctatgtcaacggaaccaaattggggagggggctgggagcaagctatccctgctattcctgcatccccctgctcttccctatcctgaggacaagtgctttgagatcaatggcaaaagggggcctgcagttcataggcttcaaggaaaggcctccactatagaaaggcctcccattcaaagctgagaatgagtggtgggacaggggcaaggcctgcttcccaaagaggtggcagcataccacagggcaaggacagcaattccctttcccatttctggacccatggcagacatggctaaatgaatactacactccttccatgagcctggatgtagcctcggaatgcaccaggcaccactaagaaacttgaaggtggcacttaagatacaacttcttccctaacccagggtcttggtggttgggagtgggatgggtgtcggaggctccctgggagggatcagagtcagagccctgtctttgcaagtgtcacacccctgctctggcccactctgagctttctagctccatccttccattccttcctgccctggtttaagtgcatttagtaattacttcattaataacagcaaaagctatttgcatctgcccaccagccaagaccaggctgctgcttgagggattcctgctcctctgctcagagagaatgatgtggtcactgatcactgtgagctccagacgctcccaggaacgcaggcagtgaagctgcaataccatctgggggctcaaagggaatttcctcttcctggatattcctggttcaaggctctagggcttacctggcccactggcccctactggttcaggcctgtgaagggctgagggtggcttcaccaggcactgagtagacttaaggcacaaagtcagtttctccaacccaggcagggctggcctcggctgccctgggacttcttgggagccaagccctcccagggagaagaaacctcctgggccacacttaaagcttagaagtccgagtctggcgtaacaggcaaaccccagaaagtccactaccaagccatcccccagggaacagctttaagggggagagccgtctgccctccattgactcatgggggtccacccaagtctcttagggctggatccgagccccctgctgatctcaaaggtgggcaggtcctctctccaaaagggttggctccagtctcaaaaggggaggcaagggagaatgggctctgaacaaatcagggccacaggcttccccttccctccagggcacctgaaccagccctccaaccaccatatctggaaagaggtaaactggtcctgtcctggcccctagggggtggcaggcaggaaggcccaagaagtctctggctctcaggttccctctgtgccgtgaggggcgaccagctggaacagcaactccagtgtgaagacttccagtttcaccagtctcgggtagggccagtgaacagcagagctggcctgcagcgggctccagtgtaacaccattgcatccagtgttggggggtgcctgggcacccctggtccctggtgtggtgctgcctcaggagggcagctcagtcacacaggcggtagaagtggaagtggtagtctgtggctggctgggcgagagcctctgaactgcagttggcctgaccctgggtggaagggcagtgggaaggtgaggtggctctgggggtgcggggcagatggcactccctgctgacattgcttgacactgtgcccccagccctaccacatactgtgcaaaccccccattcctcaagccccacgtcgcagacaggggtgcccagacctccagggtaggtgggatgcccctgctcaccagcagtgccacccggaagtggtaggtgaattcacggaaggacaggatggttattggccaccggtgagaggtgccctggagagaagggagagaggggtcaggacagactgctgcccttatcccaaccagcatctctcaccacggccgtcgcagtcctggggtctgtggggagttttatgaaggaaaaaagcagagaactttgaagagataggaaggagcatgttctgctttggcagaaggagcaatggcagctactccatgcagaccgtgcccgggactggcaggtccacagccacctccacctggcccctgcctccttcccagtcctgttgtgctgggttccctcacccactatgctctgggcacatcaaagtatttcattagccccatcctcagtacaatccagtgacacagtgctgctactagccccatcttctggatgaggaaactgagccacttcctaaaaatcacacagtgtggcaaaatcacacagctgggattcaaacccaggtctgtctggctgtctccctcacagggtggcatgcagcctggctgcaggcagcttgcccatctacctgaggctttggctgtgcgtctgtgatgtggtttcaggcccgagcaccatgtctgctgtgtgtctagctgggctctccctctgtcttggacactgtctcttctgcagggcgacagggctcgggcctccctcagaagcacccccacctctgttgcaggtgctttctgcacgtcttttctccctcactatagagtacgttcttggaagtcaaaacctgtgtctactccacctctctcccctgcagctaggcccacccagcacagggcctgggacagatggggccccaatcaatattttctgagtaaacacatgaatgggcaagaaaaaataatcactacttcccttcatttgtcctgagcgtcttctcccatggcctcttaggctcaagaagaaactgggggtccatcagccccagggacagtcataacttccggttacctggccagggaggagctcaccatccagttctcccagaagaggtggccaaacatggaacctgaggggccctctgatgctgtacatctagctgtgccacttccccaacctgagcatgaggtcggctccttcctgcttctgcagacacctccagtgagccacagccctccccgccatgggctcccagacacctgcctgtttccatcattgcactcatccacattagcacctgtgatctgctgtcttccccacgtctccagcacggcagggctgggagatgctcagcagagtgcaatgaacaaacacgggcacgcgtgcccctccctgggacacagaggcccaggccccagagtgtcccttgtggagaaggctttactctataactcccagcttctgctccttgcccatttgggggcccagttgtgccaggagagaagcagctcgggcctggccggcccgcagcttcccagtcccacctacctgggtgtcctggtgggtgtggagactctgtggaaggctcccctcctcacatggttcctcctttgacctcaggctgcacagcaccacagacacgggggaggaggagctgtagacaggcccagttagcagagaaatgaggttctagagtccctcaaccccagccccctcccagccagcctgccacacgcctctgaatctccacccagcctgaaacaccgcataataaccagggccctcgaacaaaacctttcccatcgaccatcccatgtggtcctcagcccatgaggccaggtcatttagccagttaaccacgaagtaggcaatgaagtcagcacttatcccaccatgcaggaaataccagagactctccggctgtcctcagactcggctgttctgaggctctgcgggagattctccctggctcccctcctgcctcccacttccccacaccggcactcacttcatctgcagagtcaggctgaggtgcagtggggtgccactgctgacagggatgtggtaggtgaagttcccaggcctgcaggggcaaaactggcaccttagcctgagggtaccctgccaccccccacccccaccagggactcctcagcccccaatctgtactggagccctccagaagagacagtgtccaagggtagcctggaaaggggctacccttccttatgggggaggctcctccctgaaagggcaagttccgggtgatctgtaccacctgggctcatgtcacctgaggacctccctgggtgaggggagggagcccagcccacctgcaggcatcccctggagcacagtactgggaggtgatggacatcgaattctccagcacctggatggaggtcagggagggcactggctctgcaaggagagaggctgttggggcaggagtaaggtgacaaggcaggacacaaatgagaagctggcaagtctttccttgccagacttgaagcagtcactcacaccttagtatgaataagttccaggttatttttttccagacctccacaatggccagcatcacactacaccctttcctcagcagccctaggactacccagttcccatgagcctgacgtctgcctcctcaaaagaactggaacacccagaagtagggatgggtcttcacatcccctgccaggtgtgcaggagcccgctcgaggcctgtgttcctgactgcgggcatctctcccagttctgggttcagaaacatcagttacactggtagcttgaaatcagcagtgttgacagcatcacacaaatcaggctcccctctgccccgaggccgatgattacaccgctaccagcacgctgctcctcgcagcctccctgaacaaaccgactgcaggctggctggctgggtaggggtgggactgaagtgtgacaagtcagatgggggagacaggacttcttgctcatctagttcacatacagtcttgctgctgcctgactatccacccaggaagggggaagctggggccgctgaacatttgctggacctggtacgttttcagctctgaggcatgacccagggacccaaggaccccaacaggatccaggacaccctgtgtggtcaggacaggtatcagatacagacgagatggaaggtgcccttcccacatcccttctgggcaaattccaaaggtcctttaaagagtcagctcaaatgtcaccaactccagagaagttttccctgatcctccccaccttcgtccggattaagtgtcctccccagtcccaaagctacctgcatgtcccctcagagcctcatcacactgctgtgttttcatctctgtgaggtctttggggacaggggcgtgtccatcttcatcacccccagtcccctgtacagagccagccacagagtggcaggcagctcagtaaacaggtgcctggcaaacatctcccccatggggttcccccatcacattgaatttccatctctgtaagccacattttccaggctttctttttcttgaagccacaaaatccatcagatgaaagttggtgagagcagagctgcctggttgaagccaggaagcctcccagcctccccttcaacccccagggcagcccccagcgcagcccccagggtacctcagaggaacccagtttgaaaactacaataaaaggttctgtagctttgttaaaaccaaagatccaaggtttgggaaatagtaggggagacccagtatagcaccctcctggtgctggcatggcgaaggaggagccaggctcgggatcaaatacaagccctgcctcggaggggctgtataaccctgggcaggtcacttcaccttagtctccatcccatttcttcagctgaacaataggaacaacaattcctttcttgcaggagtgctgtgaggactaaatgggatgatctacgtaaggctgcaggcctgattcctgatccttattctgtgctcagcaaacgtctattgactgacaagtctgaacccagacagtcacatgactgggctgaggtgggccctggccagtgagccttgccaggctgggctgggtagtgtcaggggtgcagcaagtacctgactggccctgggcccaggtgggctcagcagggcccacgctggactggagggcccctcggcgggcccggccatggaaaccaaggctgggactgttcttggctttgccctgccccccagggaaggggactgcagggctggccagaggctccagactcttgtgatgcttggagtggccaatgccattgactgaaagaccccaggacttggctctgatgttggtgactggcagaagg

SEQ ID NO: 14186 - DNA, 4443 bp, Homo sapiens
acattttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtatcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaagaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaac

SEQ ID NO: 14187 - DNA, 4356 bp, Homo sapiens
ttttggttacttttagaattttattgacttttttcttcataactttaaaacaaaaacagcgcatgaaaaccagtgtcttattccaaagtctcaactcagctgatttgcaggtgaacatcaccatcttactcctctgaataactagacacaaatacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtctcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaaataacaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctccc

SEQ ID NO: 14188 - DNA, 1572 bp, Homo sapiens
tacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcccagtgactacaggaacaaacgccaaaggagagagaagaagggagggatgacctgctggaccccagggcagggacagggccaagacactcacaccattgccagccgggcagctggcagcttccagcaggtggcccacttaccttccctgaagcccttttaccacaggcttaaggcaactttggtccaaggttgaccccctcaagcagcttggatccccagcctgtccccaactcctgcactgaggaacccctccccaggcttggaaacagagccagctgctaacggttttggggctgtgctgtgtccagatgggctccatggggcagtggacggtcactttccagttaaggactgagggcccgcagtccaagaacatgaacccccattgaggaagcccaggaatcctattacatggagtggggctcggcagttttaaggcatagggaggattcccccagtgggagggagaacaaagtcatcataaggaaggctcagcccctgcatggtttgggaatcgtaaaattcctatgtcaacggaaccaaattggggagggggctgggagcaagctatccctgctattcctgcatccccctgctcttccctatcctgaggacaagtgctttgagatcaatggcaaaagggggcctgcagttcataggcttcaaggaaaggcctccactatagaaaggcctcccattcaaagctgagaatgagtggtgggacaggggcaaggcctgcttcccaaagaggtggcagcataccacagggcaaggacagcaattccctttcccatttctggacccatggcagacatggctaaatgaatactacactccttccatgagcctggatgtagcctcggaatgcaccaggcaccactaagaaacttgaaggtggcacttaagatacaacttcttccctaacccagggtcttggtggttgggagtgggatgggtgtcggaggctccctgggagggatcagagtcagagccctgtctttgcaagtgtcacacccctgctctggcccactctgagctttctagctccatccttccattccttcctgccctggtttaagtgcatttagtaattacttcattaataacagcaaaagctatttgcatctgcccaccagccaagaccaggctgctgcttgagggattcctgctcctctgctcagagagaatgatgtggtcactgatcactgtgagctccagacgctcccaggaacgcaggcagtgaagctgcaataccatctgggggctcaaagggaatttcctcttcc

SEQ ID NO: 14189 - DNA, 1572 bp, Homo sapiens; identical to SEQ ID NO: 14188

SEQ ID NO: 14190 - DNA, 4355 bp, Homo sapiens
ttttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtctcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatcctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctccc

SEQ ID NO: 14191 - DNA, 30620 bp, Homo sapiens
acagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaa

SEQ ID NO: 14192 - DNA, 595 bp, Homo sapiens
ctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaa

SEQ ID NO: 14193 - DNA, 1366 bp, Homo sapiens
gttccatactatagaaaaatgtaaagttttaaaattatttatccagtggttgcaaaattgaaatcaaaaggggattaagggaagaaaacagatagatacacaaataatataggcattcattctgttaatattgagtaattactgtttgtcagacactgttttaggtatgaggaaatgacagtgagcaatacaaaggccacattctcatggagtaaaattccagaggtggagacatgtaattaatacttaaatataaaacagtagattttctaaacgcagaaaacggaagagtaacaagaaactaaatcaaggagcattatatagcctagactgcagagactcaatataataaagttggcgattcttcctaattatcaaatttactgcaattccagccaaaatgtttcagtggttttttttgtttgttgtttttgtttttgttttgccctttagcttcacaggtttgttctgaaatttatgaggtataaattcttaagagcagcaagaaaaatttcgaatctatttgtagaaactgcatatgatgatggttcataccagtagagagaaagattggatttgggggtattactagtagtaaggggattcactagtagtaagggaaatgcaaaataaaatcacattgaactagttcaaaatcatcacattggcaaaagcattagagtgccaattactggaaagatgtggagcaataggaacactcatacggtgctataggaagtagttgtgtttagcataatttggcaatgtctagtaaagttgaagatgtgaataatctttgacccagcaattccatgtttaaacctctacatagtctctcctcgtgtttcaaggagatacatatgatggtccattgcagaactgtgagaatgagaagttgaaagcaatctaaccattaggttaaatacaagatagaatgcaaactaaaatgaataactagagatatttctgtcaacatgggtaaacctcaaaaatagtattaatgaaattgaactacagactattttatataatacagtataacgtacaatttcaaaacatgcaaattagtgttatgtatttttgtcatggctaaatactatataaaaaggatctaaaagaattaataaaataatcatcagattcagaacagtggtgacctgcagggagaaagacaactgagattggggaaaggatgcaaatgaaaatacctttaattattcatttcttttaaaaataagcaaatactgtatagccaattcttaaaatttgataaagctggctgtgagtatatgagtcagttcttactctctgtatctttctgtataaactatttcataatgcaaaaaaataaagaatatttaaatga

SEQ ID NO: 14194 - DNA, 1366 bp, Homo sapiens; identical to SEQ ID NO: 14193

SEQ ID NO: 14195 - DNA, 397 bp, Homo sapiens
atgagaaatttgcatgtaaaatacttcatatagtctgtcaaatatagcagatattcaataaatgataatagctaacatgtattgagtgcccactacacatcaggcactgtcttacatactctacatatattaactcatctactcctcacaaaacaagattccttattggacaaagtggagcattcctgcaaaacaccagttcagaatttggaaaatctaaaaatgttagaacataaatggcagtctttgtactgtagcttagtagttgttatgaagtcaggtagtggaactataacactgacagccagttttaggaagtttctacagataatgaattggataagccaattaagaaaaatagaattcactgggaagaatgcagaacctacatttaaat

SEQ ID NO: 14196 - DNA, 397 bp, Homo sapiens; identical to SEQ ID NO: 14195

SEQ ID NO: 14197 - DNA, 5983 bp, Homo sapiens
cctacgccttccagcccaagtgcacctacgtcgtgagtgctgccctcctacctcggtgtccccagccccccgccctcctcacccttctctggactcgtggatgtggcccacagagccctgcccttaagcatctcctcatcacctctctctctgtccttagaacatgctcaccttcactttggagcatggagagtttgaagatgggaagggcaagtgtccctatgacccagctaagggccatgctggccttcttgtgggtgagtggctgccccccatgcaggctgggtgagtccttggggcttggttccacttgggtctgtgttggccggatgtgtccatacctcatgtgtggcctagctgacctctgtctcccatagatggtgagctgtactcggccacactcaacaacttcctgggcacggaacccattatcctgcgtaacatggggccccaccactccatgaagacagagtacctggccttttggctcaacggtgagccaccggggggcctgtgggagccatgggtgggaggtcccccggggcccagcccctccctgctgacctcctccccttcccacagaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaaggtaccgagtctcacagcggtgggccctgggagccctgctggcccagcggggctgaccggcagtgtccccttgccgtctgccagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggtgagttggccagggctcccacagagtggggaggagctggggttcaggtcagggacggtgcatgggtgggagcctggaccaggcctcagaggcagtcccggaagccaggtgtccagaagccaaggagaatgctggcacctgcccctttcagagctgcctgtgaaggggcagggccccatgccaggtggcacttgagctgccagggcattctggtacccatggccagtttgtgccaggccctgccttcctgctgcttgcccttagctgggggtgggaagagataaggtgggtacctgaccctgggctccctctcgctgtgacaggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcggtgagtgctagggcagggatgcatctccccacccagctgcggtgccatcccaccctgctgatggcctgccccccacaccctgcccccagtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggtgggtgcatgggtatgcaggcatggctgctcaaggctgggcagaagcccgtgtgcccagggcagggagatttggagctgccccacggccttgtgccctctcatttacaccttctcctctgcaccccccaggagacggctggctgctcaaggctgtgagcctggggccctgggttcacctgattgaggagctgcagctgtttgaccaggagcccatgagaagcctggtgctatctcagagcaaggtagtaagttgggccctatctgccactgtccccagcactatcccatctcactctctccatctggctgcttctcccagttgggcctatgtgcttggccagtgcagagttaggaacacacacacatgtggatgcacaccttgcctaacttggggtgggttcctggaaacgagaatgaaaacagaatggaatctgcactgcacagggccattatatatagccaggtcacggggctgcgctcccagcatcaagccttggcaactgctcccatgtttctttcagaccctccaagctgtgctgtggttctggctctggcctcttccctgaccatgcccctgtgaccagacctcccaggctgtgagatgtttatgatgccctcaccatggtggttttccttccagcccccatttccgtgactgtttccctgaagtgcttgcattatacccttgtgcaatactctttttggtttttttttgagatggagtctcactctgtcacccaggctagagtgcagtgacgcgatctcagctcactgcaacctccacctcccaggttgaagctattcttatgcctcagcctcctgagtagctgggattacaggtgcctgccactatgcccagctaaaggttttttgtttttgtttttgttttctttgagatggagtctcactctgtcgcccaggctggagtgcggtggcatgatctctgctcactgcaacctccacctcccgggttcaagcaattctgcctcggcctcccaagtaactgggactacaggcacgtgccaccatgcccagctaatttttttttttttttttttttttgagatggagtctcgctctgtcacccaggctggagtgcagtggcgcaatctcggctcactgcaagctctgcctcccaggttcacaccattctcctgcctcagccttccatgtagctgggactacaggctcccatcaccacgcctggctaattttttgtatttttagtagagacggggtttcaccgtgttagccaggatggtctcgatctcctgaccttgcgatccgcccgactcagcctcccaaagtgctgggattacaggcgtgagccactgcgcctggccagccggctaatttttgtatttttagtagagacaaggttttaccatgttggccaggctggtcttgaactcctaacctcaagtgatttgcccacctcagcctcccaaagtgctgggattccaggcatgacctgctgttcctagttgccttgtgcaatactcttgtggcatgtttgctacacctcctgaactttgatttgtttgccttttaccagctattatgactcaaaattgtcccctagaacatggaataatggcagaaagaaagtgtgtggttgaataaacacacagattggcatccaccgttgaaacaggaaaacatcttatgttatgctgctgctgttgtgagggctgatgggccttgaaatgtatttcctgcactatgtgtgtgtgagtgtgtgtgattatactttttggcctcacagccccatcatccctttctaataacgtcacgtcgataaggggcttaggattgcatctggcctgtgtaagccctctgagttctgcggttcttagagttcccttttcagcactatagctctgccttgttcccttgttcctccttctggcgccccgtgctgtgccccctgcaggagtccaagctgtccccatgctgcgttctggtccggccgcccctcccgtggtgtggccctggccgacccccctcctgcgccccgcttttctcgcagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctgggtgagttgggctctacataggccaggacctccagggactcagggtggttggagccaggctgctgatgtaccctacatcccctaccagatctctactgatccagcatgtgatgacctcggacacttcaggcatctgcaacctccgtggcagtaagaaaggtgagctttttcattcccgtcgcatcgggctgagccctggaccagagctggagtttctgttctcctcttccccagccctgctttcctgcactaacatgcactctgttttctctgccactacagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 14198 - DNA, 486 bp, Homo sapiens
aaaccgtggagcgcgccccggcccgatggctcacgcctgtaatcccagcactttgggaggccaaggtgagcggatcacgaggtcaagagatcgagaccatcctggcgaaaccccgtctctactaaaaaatacaaaaaattagccgggcgtggtggcgggcgcctgtagtcccagctactcaggagtctgacgcaggagaatcgcttgaacccgggaggcggaggttgcagtgagccgagatcgcgccactgcacacaagtctgggtgacagcgagactccgtctcaaaaaaaaaaaaaaaaaaaaaaaagaccgcggagcgcgtggcgcctccctgccctagggactaggggcggtaaagagaggaggctgcgaggtcgctggacggctgggtcatggcgaaggtaacgggaaagctcccgaccggacccagctgcctcatccccacaccctgcaaggccaggcggcccggcggccctccagcggc

SEQ ID NO: 14199 - DNA, 2718 bp, Homo sapiens
atctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggatggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtagacatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacacagtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttgaacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtattcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcaggtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtgtatc

SEQ ID NO: 14200 - DNA, 101 bp, Homo sapiens
gcttgaacccaggaggcagaggttgcagtgagccgagatcgctccactgcactccagcctgggtgacagagtgatactctgtctcaaaaaaaaaaaaaaaa

SEQ ID NO: 14201 - DNA, 7712 bp, Homo sapiens
ttttttttttttatataaagatggagtcttgctctgttgcccaggctggagtgcagtggtgtgatttcggcccactgcaacctccacctcccaggttctaaagattctcctgcctcagcctcccgagtagctgggactactggtgcatgccaccatgcccggctaattttatgtatttttagtagagacagggtttcaccatgttagccaggatgctcttgatctcctgacctcgtgatctgcccaccttggcctcccaaagtgctgggattacaggtgtgagccaccacacccggccacatatgaatatctttaagattaaatgattctttgactttatgaggtcactatcaagatacgtgaagaaataaaatattttatttttcaggatgttatttctgacctagtatgtttctgtgtttaagcattcatatttatatctctatggcacttttttttttttgacacaggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacaccatcaaaatatctgatttcagagaagttacaataataaaaaatgtgtatcttggaatcaatgaaatgtggcgattccagttatctgaaagtcttacagatataattacactgagctcttattacgtatcaagtaccatgctaagtgtttttacatgtattatctcatttattcttcatagaaatgccatgaggtagatgctgtcttcattttcattttgtacagggaaacaaggtacagaaaggttcataaccaaacaactagtaagtagaaaagacaagatttgaacaaagtagtctgacttcccagtacatcctcttaatttatccttattgcctgagaaaaagcttattagtcccttcagaacagaaaaagtggtccctggcactaaattcttaaggaaatctatcaagtaggaggatacagagtgtccttattgccagataaagtccagtgttgtgctatatgtaatggagagtcaccagagggtttttagcaagggagagacacaattggatttccaagggtctaatctgatccaacaacagaatttgtaatatctgaaaaaaatgaatagatcacacattccttagctagtctttcctaaatttcatttcacttatcattaactttcgtgtgatgtctgaatgcatttgaagtatctttgaaaggaacatgccacatattttggccaaccccacatcttaccctcgtgtagttcgtgctgttactataagttgcaaagctttggcctgcagcctcatgtgatgtataatcaccacctgcttattctccacaccactgtacatgaattccattttgtaggtctcttccataatctataaaggaaagataattaacaatcaataaaaatatcatagtcttacttgagagcagcatagaattctactgttaaatgaccttaggtgaaactcttaactgagattttacatccttatgcttttaagtgttgaaagaaattagtatagtatgccttgtaaaaagagaataaattattttgcctacttaaaaagaagactgacctggtaataaaatcatcttagttgatgatgtgaagataagaaagtttaatcactaagcaaactgcaaagcactgaaagcactgcttcttaccctaaatgaagcccactctgctgtgggaacaaattaatatatattatgtatggaaacccaatccccacaaagtcctcaagaattaagcatcaggaactattaaccatatgttagttatcctgacagactgttccatgggcctggtctgagggagtttgggacagaaataagtgcaagaaaacatttgtctatgaccccagatcaagtccccgatcttgctcggttctatccaaataagcgattttcatcaaaatgatgcttctcttttccttctgtgcttgcctcccagtgaacactctagggtcacggaaatgactccagactctcttacaattggcaataagacaagttaaattacatgagtgtctcaatccctttctgtaaacagggaagaaacagtaccaatatcatgaagtttcaagtatcaaatggagcatgcaatgtgtttatcacagtatctggtatacagcaatggtaattcctttcctcttttccttccaaattattgctccctggtcccatccttccaatgtggctcaattatcgggttctagtcattaaattctactcttctacaataagccacataccaggtctgagaaagagtctggatcagacaagagttcagcactgtagtagaaaacagattctgggtatcagaggatctggtctcaagtcctgactgtattacctatagctctatgaatttaaccttgctgagccttaactgcctcatctctaaaacagacttaatacttattcctatctaatgggattattatgagggttaattaagctaatagacttgaaatcatttagtgaactgtaatgtaacaataacagtcaccatcattagcttcctcctgggtcatttacagactccctatctggaagacttgacctgcaagagatcaccaagtctcaatactcaggtgcaaaggggaatgactcaaagctaaaaagaaataaactagagacaaataaaattaaagcctacttaatgaactacccaggaccttttaacgttgaagagatggtacaggctaaagatataaacaaccttaactgagttgggctacattttcagatgaaagattcatgatagtagagacagcgtttcaccatgttggccaggccggtctcaaactcctaaccttaagtgatgtgcccatctcagcctcccaaagtgctgggattacaggtgtgagccaccgcgcccggcccaactgccacattttatagaagagaaaaaatccagggaatttaagtaacttgctcaatatcactcagcaaatcagaggaagacctgggactaggacccaggtcccctgagtccaaagtgagtgctgtgtctcctagttatgctccttctcatatcactaacttctgtcatagcctgaaattagggaggccacagcagaggtatagagctacaggaaggcctctggctccgccttggaccagacaattcctggacagagacctatttgaagggaaggtctgaataagcttacctgtgttgctgctgctgaggccaaatcactctgcttcaaatacaaaggggcagctacatgccacaacttttcctgcaaggcctacacagacagagctataggaaggcctctggctctgtcttggaccagacaattactggacagagacctatttgaagggaaggtctgaataagcttacctgtttcgctgctgctgaggccaaatcactctgcttcaaatacaaaggggcagctacattccacaacttttcctgcaaggcctacgcagacaaatcaggagggaacagaataccgaggtcacaaagactggcctatcatttgggatttacatttttgttttcctttgaaagtctcccatgaacatgacttctcaattgatcttattcttttaacccaataagctgtatctattatggagaaagatgagaccaatggtttgggctaaatgaattcccacccatttgatccaattcttggcccaaaggctctgtgtcccagatcagtgcttctggaagcagaggacaggaaccacgaaagcttcaccagaatgcgcaggcaagccagcttccgggctctaggcactccttgttcccagagctactggactaacccaagccacctagatacttcttccttaactgtggttcttttttcttttcccctatgctcattatgttgtaagccccaaccactttatcaacatattcaactagaaatcaagcagctttcctagatttctccctctttcaatctttctacattcaaaaccaccactaagagccatgattttaccttccatctctctcctcacctatccatccacatgacctcatcccttgcacaaacttctgtgacagcctcttattttctcagtccttctgaattacagatgtaatcaaatgacattacagaaaacctagactaacactgtccaatagaaatataacatgagctatatataattttaaatattctcgtagccacggtttttaaattacaaagatgtaagttaattttaagatacaaagactaagttaattttttaaaaaagtttatttaacccagtatatccaagatattaacatttcaccatgcagtattttttaaattattaattagtttacattttctcttcatactaagtctgagaaatccagtgtgtattttgcacttaataacacatctcagtttggactaacaactttttgagtgctcaagagtcccatgtatctggtggctatcaaattaaacagtggtaggtctaaactgtagataaaaactataggaatttctggaatatttacttctaatcatttcttgtatgcatgttttttgacagttgtagtcagaaagcagaattaagtttggggattagatcataatcccaaaacatacaatcccaaatgttgaaatcctcacatccaaattctggggaagtgattagcgtgttttgggttgtatgcaggatagttgcatcatgttagttgtatcatgttaggcacaactattaccatgttattgtctttatttggaaattaaatatggcttaaggagatgcgtatgagtgccaagctgacaaggggtggacttgtggacctaattttagatatcagcttgactagattaaggaatatcagaaacctggtaaaagattattttgttttacacattgagggtgtgtctatgagagtgtttccagaagagattagtgtataaatctgagtgtactaagtggagactatctgccctcaatgttggcgggcaccatccaatcagccagtggccaggagagaacaaatacttaagacgaaatgggctgggagtggtggctcatgcctgtaatcctagcactttggaaggccgaggtgggtggatgacctgaggtcaggagatggagaccagcctgaccaacatggcaaaaccctgtctctactaaaaatacaaaaattagccaggcgtggtggtgcacacctgtaatcccagctacttgggagactgagacaggagaattgcttgaacccaagaggcagaggttgcagcagtgagccgagatcacgccactgtattcagcctggatgataagctgagactctgtctcaaaaaaaaaaaaatggcatattagcaaaacggactctctgggttctgctgcttggatatcagaaatctgactccatgaaagtgcatcatcacaatactgactttgtgtataagcattgagtgtgtacacaaaatgttgaaacttcctcgataaatgagatatccttttcgtacatctgcatttgtgaaagataaaatttcttgagatctcagctctttgggtgactgcatatgcagtggtgacccagcacagtttccatcaatctcgtcaaaagacttgaggttgttgggcacagtatttcagatgaccacagttaaaaagctgggtatacacaattaacaaccaaagtgatatgcatttatacctttccctttatgaccaatttctttataaatatggctcatctgctcataactgttagacccacccaactgtcattagtaacctgagtgtttatgcttgcaaaaatgtatgttgttattgtctgttttattatattaagtgatgtataaagtattctgttgtgtttttatgtttctcaaataaattcccctttaaaaaataaatatctttaaattttttaaattatttcttccataattatattttggggattttgatattttctgggctgtggtttttgggattttagaccttagggattttagtcttttggaatttaaacagtttaggactatgatgttctggactatcttttgggattatgattggctccccttcttttgggtacataacattacaccctaaatattttgtcatgttgttgtataattcttcataaagaattactgactacagaatatactgctaggtagctgtaccaaaatttatttagcttttttcctgttattaaacacacttgccttgggttctggctctgggcccctcacctacactgtcaccccttgtcattgaataaccaacaattatgtgttctttttaggagtaatcacttctctttcctcacccatattttgctactatagaaaagtggattcttctccatggcctccttgaattcctggggtttcacagaggcttggaaaagccaaacaaccttgcaaaggggcaggaaggaacttcttggagtgatgaaaatgttctacgacttgcctatggtggtgattacacagatatatacattagaaagaacatatctagcctaacaaggaccatttaagtgccaagtatacatacgcacctttacatgtataggcacacctgcacaactgtaaatataacatttagcacaagttcacacagtagaaaataacttttgactccctgatttactctgactttagccaaacatcattaatcactttgaaaacaaagaacactttgaactagggccaagataaaagttcgtcaagtgagaagggctctcctaaattctgtgccaaaatttatagtaaaattctgctacagaagctgaaagatactgaactcatttaattgttttttaactcagcaaaactaaatagattcttgggtaccaattctgtgtatagctgactactgagtaagaaacgccagcaagctggtctttttaaaagcaatgaaatcaaccttttaactttgatgaagtgcagtgagtttttttgtttgtttgtttgtttgttttctttaaagacaggatcttggtctgtcatccaggctggagtgcaatctcactgcagccttgacctcctaggctcaagcagtcctcccaactccagccgagtagctggatatacaggaatgcaccaccacacctgcctactttaaattttcttgtagagatgaggtgtcgctatgttgcccaggctggtctcaaactcttgagctcaagcgatcctcctgccttggcctgccaaagtgctaagattacaggtgtgagccaccgcacctggccttcaaatgagcattttaagaagatagtctaaaacttcatacaattcctttgctaatcaaattatacaaaacatttacaaccttgggattctaactaaaatgattatccaatctgctctaattatattatgataaaagaattctccccaaatttacaaattcctatgagttaatatttcgttaattagagacaaatgtaatcacactgcagagtacatatttctccattgtcaagtggttgcattaagaccataagttttataacttatggcctcacacactgctggatccacaaagatgcatttttagcaacacaatcataaatggaatggatgcaaaccaaccttgatgagaagtagttgacagcgaagataggtggcagagaaatcagctactcctgccaattcagattgaagttctccaagtctttgcagatccct

SEQ ID NO: 14202 - DNA, 4403 bp, Homo sapiens
  misc_feature (2735)..(2735): n equals a,t,g, or c
  misc_feature (2755)..(2755): n equals a,t,g, or c
tccctatgcttttaagtgtggaaagaaattagtatagtatgccttgtaaaaagagaataaattattttgcctatttaaaaagaagactgacctggtaataaaatcatcttagttgatgatgtgaagataagaaagtttaatcactaagcaaactgcaaagcactgaaagcactgcttcttaccctaaatgaagcccactctgctgtgggaacaaattaatatatattatgtatggaaacccaatccccacaaagtcctcaagaattaagcatcaggaactattaaccatatgttagttatcctgacagactgttccatgggcctggtctgagggagtttgggatggaaataagtgcaagaaaacattgtctatgaccccagatcaagtccccgatcttgcttagttccatccaaataagcgattttcatcaaaatgatgcttctctttttcttctgtgcttgcctcccagtgaacactctagggtcacggaaacgactccagactctcttacaattggcaataagacaagttaaattacatgagtgtctcaatccctttctgtaaacagggaagaaacagtaccaatatcatgaagtttcaagtatcaaatggagcatgcaatgtgtttatcacagtatctggtatacagcaatggtaattcctttcctcttttccttccaaattattgctccctgatcccatccttccaatgtggctcaattatcgggttctagtcattaaatgctactcttctacaataagccacataccaggtctgagaaagagtctggatcagacaagagttcagcactgtagtagaaaacagattctgggtatcagaggatctggtctcaagtcctgactgtattacctatagctctatgaatttaaccttgctgagccttaactgcctcatctctaaaatagacttaatacttattcctatctaatgggattgttatgagggttaattaagctaatagacttgaaatcatttagtgaactgtaatgtaacaataacaatcaccatcattagcttcctcctgggtcatttacagactccctatctggaagacttgacctgccagagatcaccaagtctcaatacttaggtgcaaaggggaacggctcaaagctaaaaagaaataaactagagacaaataaaattaaagcctacttaatgaactacccaggaccttttaacgttgaagagatggtacaggctaaagatataaacaaccttaactgagttgggctacattttcagatgaaagattcatgacagtagcgacagcgtttcaccatgttggccaggctggtctcaaactcctaaccttaagtgatgcgcccatctcagcctcccaaagtgctgggattacaggtgtgagccaccacacccggcccaactgccacattttatagaagagaaaaaatccagggaatttaagtaacttgctcaatatcactcagcatatcagaggaagacctgggactaggacccaggtcccctgagtccacagtgagtgctgcgtcccctagttatgctccttctcatatcactaacttctgtcatagcctaaaattagggaggccacagcagaggtacagagctacaggaaggccgtctgccgccttggaccagacaattcctggacagagacctatttgaagggaaggtctgaataagcttacctgtgttgctgctgctgaggccaaatcactctgcttcaaatacaaaggggcagctacatgccacaacttttcctgcaaggcctacagagacagagctataggaagcgctctgctctgccttggaccagacaattcctggacagagacctgtttgaagggaaggtctgaataagcttacctgttttgctgctgctgaggccaaatcactctgcttcaaatacgaaggggcagctacattccacgacttttcctgcaaggcctacacagacaaatcaggagggaacagaataccgacgtcacaaagactggcatatcatttggaatttacatttttgttttcctttgaaagtctaccatgaacaggacttctcaattaatcttattcttttaacccaataagctgtatctattatggagaaagatgagactaatggtttgggctaaatgaattcccatccatttgatccaattcttggcccaaaggctctgtgtcccagatcagtgcttctggaagcagaggacaggaaccatgaaaccttcaccagaatgcgcaggcaagccagcttccgggctctaggcactccttgttcccagagccactggactaacccaagccacctagatacttcttccttgactgtggttcttttttcttttcccctatgctcattatgttataagccccaaccactttaccaacatattcaactagaaatcaagcagctttcctagatttctccctctttcaatcttctacattcaaaaccaccactaagagccacgattttaccttccatctctctcctcacctatccatccacatgacctcatctcttgcacaaacttctgtgacagcctcttattttctcagtccttctgaattacagatgtaatcaaatgacattacagaaaacctagactaacactgtccaatagaaatataacatgagctatatattaatttaaatattctcatagccacagttttaaattacaaagatgtaagttaattttgaagatacaaagaactaagttaatttcnttaaaaagtttatttaaccnagtatatccaagaatataacagtacaccacgcagtatcgtttaaattattaattagatagtttacattttcttttcatactaagtctgagaaatccagtgtgtattttgcacttaataacacatctcagtttagactaacaacttttcaagtgctcaagagtcccatgtatctggtggctatcaaacagtggtaggtctaaactacagataaactataggaatttctggaatatttacttctaatcatttcttgtatgcatgttttttgacagttgtagtcagaaagcagaattaagtttggggattagatcataatcccaaaacatacaatcacaaatgttgaaatcctgacatccaaattctggggaagtgattagtgtgttttgggttgcatgcaggatagttgcatcatgtcagttgtatcatgttaggcacaactattaccatgttattgtctttatttggaaattaaatatggcttaaggagatgcgtatgagtgccaagctgacaaggggtggacttgtggacctaattttaggtatcagcttgaccagattaaggaatatcagaaacctggtaaaacattattttgttttacacattgagggtgtgtctatgagagtgtttccagaagagattagtgtataaatctgagtgtactaggtggagactatctgccctcaatgttggcgggcaccatccaatcagccagtggccaggagagaacaaatacttaagacaaaatgggctgggatcggtggctcatgcctgtaatcctagcactttggaaggtcgaggtgggtggatgacctgaggtcaggagttcgagaccagcctgaccaacatggcaaaaccctgtctctgctaaaaatacaaaaattagccaggcgtggtggtgcacacctgtaatcccagctacttgggaggctgagacaggagaattgcttgaacccaagaggcagaggtcgcagcagtgagccgagatcacgccactgtattcagcctgggtgataagctgagactctgtctcaaaaaaaaaaaaaaaaacaaaaaaaaacaaaaaacaaaaaaacgcaaaatagcaaaacggactctctgggttctgctgcttggatatcagaaatctgactccatgaaagtgcattatcacaatactgactttgtgtataagcattgagtgtgtacataaaatgttgaaacttcctcgataaatgagatatccttttcgtacatctgcatttgtgaaagataaaatttcttgagatctcagctctttgggtgactgcatatgcagtggtgacccagcacagtttccatcaatctcatcaaaagacttgaggttgttgggcacagtatttcagatgaccagagttaaaaagctgggtatacacaattaacaaccaaagtgatatgcatttatacctttccctttatgaccaatttctttataaatatggctcatctgctcataactgttagacccacccaaatgttattagtaacctgagtgtttatgcttgcaaaaatgtatgttattattgtctgttttattatattaagtggtgtataaagtattctgttgtgtttttatgtttctcaaataagttcccctttaaaaaataaatatctttaagtttttaaaacta

SEQ ID NO: 14203 - DNA, 7713 bp, Homo sapiens
ttttttttttttttggagacagattctcgttctatcgcccaggctggagtgcagtggtgtgatttcggcccactgcaacctccacctcccaggttctaaagattctcctgcctcagcctcccgagtagctgggactactggtgcatgccaccatgcccggctaattttatgtatttttagtagagacagggtttcaccatgttagccaggatgctcttgatctcctgacctcgtgatctgcccaccttggcctcccaaagtgctgggattacaggtgtgagccaccacacccggccacatatgaatatctttaagattaaatgattctttgactttatgaggtcactatcaagatacgtgaagaaataaaatattttatttttcaggatgttatttctgacctagtatgtttctgtgtttaagcattcatatttatatctctatggcactttttttttttggacacaggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacaccatcaaaatatctgatttcagagaagttacaataataaaaaatgtgtatcttggaatcaatgaaatgtggcaattccagttatctgaaagtcttacagatataattacactgagctcttattacgtatcaagtaccatgctaagtgtttttacatgtattatctcatttattcttcatagaaatgccatgaggtagatgctgtcttcattttcattttgtacagggaaacaaggtacagaaaggttcataaccaaacaactagtaagtagaaaagacaagatttgaacaaagtagtctgacttcccagtacatcctcttaatttatccttattgcctgagaaaaagcttattagtcccttcagaacagaaaaagtggtccctggcactaaattcttaaggaaatctatcaagtaggaggatacagagtgtccttattgccagataaagtccagtgttgtgctatatgtaatggagagtcaccagagggtttttagcaagggagagacacaattggatttccaagggtctaatctgatccaacaacagaatttgtaatatctgaaaaaaatgaatagatcacacattccttagctagtctttcctaaatttcatttcacttatcattaactttcgtgtgatgtctgaatgcatttgaagtatctttgaaaggaacatgccacatattttggccaaccccacatcttaccctcgtgtagttcgtgctgttactataagttgcaaagctttggcctgcagcctcatgtgatgtataatcaccacctgcttattctccacaccactgtacatgaattccattttgtaggtctcttccataatctataaaggaaagataattaacgatcaataagaatatcatagtcttacttgagagcagcatagaattctactgttaaatgaccttaggtgaaactcttaactgagattttacatccttagtgcttttaagtgttgaaagaaattagtatagtatgccttgtaaaaagagaataaattattttgcctatttaaaaagaagactgacctggtaataaaatcatcttagttgatgatgtgaagataagaaagtttaatcactaagcaaactgcaaagcactgaaagcactgcttcttaccctaaatgaagcccactctgctgtgggaacaaattaatatatattatgtatggaaacccaatccccacaaagtcctcaagaattaagcatcaggaactattaaccatatgttagttatcctgacagactgttccatgggcctggtctgagggagtttgggacagaaataagtgcaagaaaacatttgtctatgaccccagatcaagtccccgatcttgctcggttctatccaaataagcgattttcatcaaaatgatgcttctcttttccttctgtgcttgcctcccagtgaacactctagggtcacggaaatgactccagactctcttacaattggcaataagacaagttaaattacatgagtgtctcaatccctttctgtaaacagggaagaaacagtaccaatatcatgaagtttcaagtatcaaatggagcatgcaatgtgtttatcacagtatctggtatacagcaatggtaattcctttcctcttttccttccaaattattgctccctggtcccatccttccaatgtggctcaattatcgggttctagtcattaaattctactcttctacaataagccacataccaggtctgagaaagagtctggatcagacaagagttcagcactgtagtagaaaacagattctgggtatcagaggatctggtctcaagtcctgactgtattacctatagctctatgaatttaaccttgctgagccttaactgcctcatctctaaaacagacttaatacttattcctatctaatgggattattatgagggttaattaagctaatagacttgaaatcatttagtgaactgtaatgtaacaataacagtcaccatcattagcttcctcctgggtcatttacagactccctatctggaagacttgacctgcaagagatcaccaagtctcaatactcaggtgcaaaggggaatgactcaaagctaaaaagaaataaactagagacaaataaaattaaagcctacttaatgaactacccaggaccttttaacgttgaagagatggtacaggctaaagatataaacaaccttaactgagttgggctacattttcagatgaaagattcatgatagtagagacagcgtttcaccatgttggccaggccggtctcaaactcctaaccttaagtgatgtgcccatctcagcctcccaaagtgctgggattacaggtgtgagccaccgcgcccggcccaactgccacattttatagaagagaaaaaatccagggaatttaagtaacttgctcaatatcactcagcaaatcagaggaagacctgggactaggacccaggtcccctgagtccaaagtgagtgctgtgtctcctagttatgctccttctcatatcactaacttctgtcatagcctgaaattagggaggccacagcagaggtatagagctacaggaaggcctctggctccgccttggaccagacaattcctggacagagacctatttgaagggaaggtctgaataagcttacctgtgttgctgctgctgaggccaaatcactctgcttcaaatacaaaggggcagctacatgccacaacttttcctgcaaggcctacacagacagagctataggaaggcctctggctctgtcttggaccagacaattactggacagagacctatttgaagggaaggtctgaataagcttacctgtttcgctgctgctgaggccaaatcactctgcttcaaatacaaaggggcagctacattccacaacttttcctgcaaggcctacgcagacaaatcaggagggaacagaataccgaggtcacaaagactggcctatcatttgggatttacatttttgttttcctttgaaagtctcccatgaacaggacttctcaattgatcttattcttttaacccaataagctgtatctattatggagaaagatgagaccaatggtttgggctaaatgaattcccacccatttgatccaattcttggcccaaaggctctgtgtcccagatcagtgcttctggaagcagaggacaggaaccacgaaagcttcaccagaatgcgcaggcaagccagcttccgggctctaggcactccttgttcccagagctactggactaacccaagccacctagatacttcttccttaactgtggttcttttttcttttcccctatgctcattatgttgtaagccccaaccactttatcaacatattcaactagaaatcaagcagctttcctagatttctccctctttcaatctttctacattcaaaaccaccactaagagccatgattttaccttccatctctctcctcacctatccatccacatgacctcatcccttgcacaaacttctgtgacagcctcttattttctcagtccttctgaattacagatgtaatcaaatgacattacagaaaacctagactaacactgtccaatagaaatataacatgagctatatataattttaaatattctcgtagccacggtttttaaattacaaagatgtaagttaattttaagatacaaagactaagttaattttttaaaaaagtttatttaacccagtatatccaagatattaacatttcaccatgcagtattttttaaattattaattagtttacattttctcttcatactaagtctgagaaatccagtgtgtattttgcacttaataacacatctcagtttggactaacaacttttcgagtgctcaagagtcccatgtatctggtggctatcaaattaaacagtggtaggtctaaactgtagataaaaactataggaatttctggaatatttacttctaatcatttcttgtatgcatgttttttgacagttgtagtcagaaagcagaattaagtttggggattagatcataatcccaaaacatacaatcccaaatgttgaaatcctcacatccaaattctggggaagtgattagcgtgttttgggttgtatgcaggatagttgcatcatgttagttgtatcatgttaggcacaactattaccatgttattgtctttatttggaaattaaatatggcttaaggagatgcgtatgagtgccaagctgacaaggggtggacttgtggacctaattttagatatcagcttgactagattaaggaatatcagaaacctggtaaaagattattttgttttacacattgagggtgtgtctatgagagtgtttccagaagagattagtgtataaatctgagtgtactaagtggagactatctgccctcaatgttggcgggcaccatccaatcagccagtggccaggagagaacaaatacttaagacgaaatgggctgggagtggtggctcatgcctgtaatcctagcactttggaaggccgaggtgggtggatgacctgaggtcaggagatggagaccagcctgaccaacatggcaaaaccctgtctctactaaaaatacaaaaattagccaggcgtggtggtgcacacctgtaatcccagctacttgggagactgagacaggagaattgcttgaaccccaagaggcagaggttgcagcagtgagccgagatcacgccactgtattcagcctggatgataaacggagactttttttccaaaaaaaaaaaaaggcaatatagcaaaacggactctctgggttctgctgcttggatatcagaaatctgactccatgaaagtgcatcatcacaatactgactttgtgtataagcattgagtgtgtacacaaaatgttgaaacttcctcgataaatgagatatccttttcgtacatctgcatttgtgaaagataaaatttcttgagatctcaggctctttgggtgactgcatatgcagtggtgacccagcacagtttccatcaatctcgtcaaaagacttgaggttgttgggcacagtatttcagatgaccacagttaaaaagctgggtatacacaattaacaaccaaagtgatatgcatttatacctttccctttatgaccaatttctttataaatatggctcatctgctcataactgttagacccacccaactgtcattagtaacctgagtgtttatgcttgcaaaaatgtatgttgttattgtctgttttattatattaagtgatgtataaagtattctgttgtgtttttatgtttctcaaataaattcccctttaaaaaataaatatctttaaattttttaaattatttcttccataattatattttggggattttgatattttctgggctgtggtttttgggattttagaccttagggattttagtcttttggaatttaaacagtttaggactatgatgttctggactatcttttgggattatgattggctccccttcttttgggtacataacattacaccctaaatattttgtcatgttgttgtataattcttcataaagaattactgactacagaatatactgctaggtagctgtaccaaaatttatttagcttttttcctgttattaaacacacttgccttgggttctggctctgggcccctcacctacactgtcaccccttgtcattgaataaccaacaattatgtgttctttttaggagtaatcacttctctttcctcacccatattttgctactatagaaaagtggattcttctccatggcctccttgaattcctggggtttcacagaggcttggaaaagccaaacaaccttgcaaaggggcaggaaggaacttcttggagtgatgaaaatgttctacgacttgcctatggtggtgattacacagatatatacattagaaagaacatatctagcctaacaaggaccatttaagtgccaagtatacatacgcacctttacatgtataggcacacctgcacaactgtaaatataacatttagcacaagttcacacagtagaaaataacttttgactccctgatttactctgactttagccaaacatcattaatcactttgaaaacaaagaacactttgaactagggccaagataaaagttcgtcaagtgagaagggctctcctaaattctgtgccaaaatttatagtaaaattctgctgcagaagctgaaagatactgaactcatttaattgttttttaactcagcaaaactaaatagattcttgggtaccaattctgtgtatagctgactactgagtaagaaacgccagcaagttggtctttttaaaagcaatgaaatcaaccttttaactttgatgaagtgcagtgagtttttttgtttgtttgtttgtttgttttctttaaagacaggatcttggtctgtcatccaggctggagtgcaatctcactgcagccttgacctcctaggctcaagcagtcctcccaactccagccgagtagctggatatacaggaatgcaccaccacacctgcctactttaaattttcttgtagagatgaggtgtcgctatgttgcccaggctggtctcaaactcttgagctcaagcgatcctcctgccttggcctgccaaagtgctaagattacaggtgtgagccaccgcacctggccttcaaatgagcattttaagaaaatagtctaaaacttcatacaattcctttgctaatcaaattatacaaaacatttacaaccttgggattctaactaaaatgattatccaatctgctctaattatattatgataaaagaattctccccaaatttacaaattcctatgagttaatatttcgttaattagagacaaatgtaatcacactgcagagtacatatttctccattgtcaagtggttgcattaagaccataagttttataacttatggcctcacacactgctggatccacaaagatgcatttttagcaacacaatcataaatggaatggatgcaaaccaaccttgatgagaagtagttgacagcgaagataggtggcagagaaatcagctactcctgccaattcagattgaagttctccaagtctttgcagatccct

SEQ ID NO: 14204 - DNA, 1495 bp, Homo sapiens
tttttttttttataaagatggagtcttgctctgttgcccaggctggagtgcagtgatgtgatttcggctcactgcaacctccgtctcccgggttctagagattctcctgcctcagcctcccgagtagctgggactactggtgcatgccaccacgcccagctaattttatgtatttttagtagagacagggtttcaccatgttagctaggatgctcttgatctcctgacctcgtgatctgcccaccttggcctcccaaagtgctgggattacaggtgtgagccaccgcacccggccacatatgaatatctttacgattaaatgattctttgactttatgaggtcactatcaagataagtgaagaaataaaatattttatttttcaggatgttatttctgacctagtatgtttctgtgtttaaacattcatatttatatctctatgccacttttttttttgacacagcagctgaactgagcatcaaacatgtctgtgagctggcaatgagtcacctaagtacttttttgtatcaaatctatgatgccatcattcttaagatgcacctttattttatgaaatagtaagaaacaaaaaacactataggacaccatcaaaatatctgatttcagagaagttacaataataaaaaatgtgtatcttggaatcaatgaaatgtggcaattccagttatctgaaagtcttacagctataattacactgagctcttattacgtatcaagtaccatgctaagtgtttttatattgtattatctcatttattcttcatagaaatgccatgaggtagatgctgtcttcattttcattttgtacagggaaacaaggtacagaaaggttcataaccaaacaactagtaagtagaaaagacaagatttgaacaaagtagtctgacttcccagtacatcctcttaatttatccttattgcctgagaaaaagcttattagtcccttcagaacagaaaaagtggtccctggcactaaactcttgaggaaatctatcaagtaggaggatacagaatgtccttattgccagataaagtccagtgttgtgctatatgtaatggagagtcaccagagggtttttagcaagggagacgcacagttggatttccaagggtctaatctgatccaacaacagaatttgtaatatctgaaaaaaatgaatagatcacacattccttagctagtctatcctaaatttcattttacttatcattaactttcgtgtgatgtctgaatgcatttgaagtatctttgaaaggaacatgccacatattttggccaaccccacatcttaccctcatgtagttcgtgctgttattataagttgcaaagctttggcctgcagcctcatgtgatgtataatcaccacctgcttattctccacaccactctacatgaattccattttgtaggtctcttccataatcgataaagaaaagataattaacaatcaataaaaatatcatagtcttac

SEQ ID NO: 14205 - DNA, 952 bp, Homo sapiens
ttttttttctttttccttttttttgagacagagtttcgctcttgttgcccaggctggagtgtagtggcacaatctcagctcactgcaacctccacttcctgggttcaagtgattctcctgcctcagcctcctgagtagctggaattacaggcgcatgtcaccacacccggctaatttttgtatttttagtagagacaaagtttcaccaccttagccaggctggtcttgaactcctgacctcaggtaatcctccctccttggcctcccaaagtgctgggattacaggcatgagccactgtgcccggcccccatgcctttcataaatatataaatttcattcctatctccataacgtctcatcttcctgaactggaaaacgcttctttctctcgcccatttgttatctctttgataatttcaacagctcttttcctataccatctctaccattagaaggtaccccttctacaaccactgcattcaaggcctattcattttcatacttcgagacccagttaaaacagcatgtcttccatgacagtttcccacttgggtttattcactctgtcttctgagatcctcaactccatttcttctcatcctactacaaatatttgcacattttcactaaccttacctgaatgaaactccatggaacatttggttcatctcagtattgctactgcttagaaatactgagacttggcacagagttaagttctcagtaaatgctggatgaatgaatgaaaggatagaggtatatgggtcaggaaaggaatgctttgtctttgggagcttcagtgctaaaagcattgtccttgtgcagaaacataacaggtggagcccagtaggttgggctggtagttcccaaactctaactcccatatcccctttgctgacacagaggtagttcaagaagctaccatcctttaatgctcaattcatctttgtt

SEQ ID NO: 14206 - DNA, 1531 bp, Homo sapiens
tggatacttgctgctctactgctagactctcctcctctacaggagtcaggaatgaattcctggccattgcattaatccctttagacccaagcatgaattagctgacctgtggttatttccccttgccctggctgccaggctgctggcaaagtgaccatttgcccacttacatcctcattatgggaggtagagccctcccgatgcctgtgctgattccctccgtgtaagaaggatgcgtagttgttggtagtcccacgaggcaaatagctacactcctttgcctggctctctggattctgcctcttttgtttttaccctctctgtgcttatggctctacccttctccaccttccatttcgctcagtttggtttccttactctctctagaccatgtctttttcatttccatgtacttaccattagtcatgtgtgcctcttacctaaaagtgtgtccgtctttcatttccttcgtaaatttaggcaactatatgagtattcctgggttgttttggattgagtgagccttaagatatgacagctctagcacacagtaggtactcagaaaatgttagcctctgtgctggactgatttcatattttaccccaagtggttcatgtaactagggggagttttgcttcacactattaaatccactttaaagaattagtattcatgaagcacttagaactgtgcttggcacatagtaagcactatgtgtttgtaaaataaaacttctaccttatttgactttttaaaaattgtaatttatttttatgagaataatgcagctctggttttgttacctatctcaaaaacttacttataaatgggtacagtaataatttataaaaaagaaaatgactttacatgttgttcatatgtgtactttccaataaagtcttggaatatggtgacaatttagaaatatgtggggttctttttttaaaggttgtactgatgaactctcattaaaaggaactgctatattttgttgtttattgtagaatggaagctacaaaagtattcatgcaatggccaaagatatagatctcctcgcaaaaaatgccaaaacttataatgagcctggctctcaagtattcaaggttagttttgttgttgttgttgttgttgttttccttggtaatagtagataatttaaggtcagtaatttttataaaacaactttattgagatataattcacataccatggactttacccattaaaagtgtttaatttaggctgggcgcagtggctcacgcctgtaatcccggcactttgtgaagcctaggtgggtggatcacgaggtcaggcgttccagaccagcctggccaacatagtgaaaccccatctttactaaaaatacaaaaattagctgggcgtggtggcaggcgcctgtaatcccagccaatcgggaggctgaggtaggagagtcggttgaatccgggaggcagaggttgcagtgagctgagattgcactccagcccgggcgacagtgcaagactctgtctcaaaaagaaaaaaaaaaaa

SEQ ID NO: 14207 - DNA, 195 bp, Homo sapiens
ctggatattatacccttatcatgtaaatggtttgcaaatattttctcccattctcttgtcttttcacttttgtgattgtgtctgttgacacacagaagtttttcattttgaagttcactttatctatttttttctttggttgctaatgcttaagtgtcatatcaaataaatcattccctaatccaaaatcacaaa

SEQ ID NO: 14208 - DNA, 1967 bp, Homo sapiens
tttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 14209 - DNA, 3201 bp, Homo sapiens
tcagaattaaatcattttatttttgccacaagaagctctaagaactaatatcaggccatggttaatgaaaagtagaacttaaagtcatgacagggaagattgtacaagtgtgaacattacagtactcggaggaatgaacaaggtttcatatagttgaccagccagaaagccagtgctgttaagttagcatttaattctttagaatatgcatgccttgacaatacaaaataccttgatcagtgtttaccatttttttatctttttggtacaatgggggaaaaatgcggcattatttcttcatagtggttgtgtgtgggggatcgttaccaccaaaatcataataatcatttaaagtatattttaaagttagtctcgcaagattgttatggcatttttaaatttctgtagtttaagcattttcattttgtcatatcttttaacaaattactatttcaagtagttcctatccagaatatttacaggtaatttagcataggagcaaatttgaagctaacttcaaacaagaaaaggaagttcaatagccagagagctaagtataagataaaaaaacaatatggtaattttaaacagcatcttgctacagatttccaatccaataaataccaggaatgaaggacttttgccccaaagaagtatttcacatgaattctgaactttggatatggaaacttatagaaaaactgaagaccctgagacacatgcaagtaagagtcttctggcaaaaatacaatttaattttccagtttctctcctcccaaaaactccagaagatacctttagtaggcacagagtttaaatgtcatattcagaatttacagagcacagcagcagcagcaaataattacatacctattattcagaatggatagttttccattatagaattagttcctggtttgtcataatagacttgtagaatctgccaagttttattatgacaaactaattgacctagcagttgagtctgaaagatctggaagctctgccggcatccgtatcattcacatcggtagaagtaattatgtctaactggtgaaatagcattaatgaaactcaaaacaaattttcactgagtacatttcagagtgcacactatagtcaaagagtaatgttattaatatctacacaaaaaagaaacatatggtgattccagagatcacagagtcttaagttatcaggtaatttcaaatttcccaggggttagtttacaaatggtttgaaggtctagacttacagaacagaaaacagataaatgcacatcactctacctcttggcaagcaaaggattttttttcttgtattattgcatgaactgatgcctgataccctcagctaccaacttaagaaacactgaaaccactaccttcaaatccagcttaccatcagaagaacgatgtatacatgagaaattatgattaaagctttaagttcaaagtcaagaaatagactatattttaaaatacatggtcaggagaaagaaaatatctatgttggactaagaaatacttaagcaaggttacaaatgactaataactatgcacaacaatcttttccagtatcaattttttcctttgcaaaaaaaaaaaaaatcatttacagacgttcaacaattctgttataaatgctaggctatatgtatgttccaacctgttttcttttagtactagcacagtttagtactagcacttcagtaagtgttaactttattttctaagtgtttaaatatgtgtcatttttaaaagtggtatttattgttgtcaagaaaaatgggaactgacaagcctatataacattccttatgtagtttctgattactataatattgcagcaatttgcagatggaataaaacttattttagaaggggtaaaaacctaacaaatcttgccgaaaggaaaatactagatcactgattcaactatttcaaataaagacttcctagtggagattctacgcaatatgaacatttaaaaatatatgccagtagcctcccacccaaaatatgtaaagtctcacccatggaatctatcatttacaaggatttatacataaagatacatttggtggctttcagattcaaaatttgaaaattttcatgttcatgggaatatttttaaccttaagaagccaaaaggaaatcttcattccattctctactatgtggtagccagagaattaaaaatccatgcaacagaacttttcatctcctcctatctgccattacagagattgttttcattagttttttgcccccagagaccacactgcgaaggtataaagtggtctagccaccaaagtcttttacagactatggcaatgaaagccaggattaattctaattagctaaatctaatttgttcttcagatgagagacttgtctgcatggctattttcatagagggagggtagcaggaggttgctgttcgcttggactagcagattacacaacccaagtactgacttattctgacattttccagaacaactctaaaacttatttactctttatgccatatacaagacaaaacacacatttattgtctcaatgttaagaaaattgagaattcagcagtaaagtgctaacatggaaggggaaagctgtaagatgtactagggtatgctaataactccagttattttcaaagaacattcagactgcttcaaattctattcaggaaactatctctccaagcttttaatttttgcctcttttaaatgagctgaaaactaactatataaacagatacttggggagggggtctcacctctactcaaaactttcaggaaaatttgcttctaaaaattatcaacaaaaatcccactacacttccttcagataatgtggcagatcaaattaacttgttcgcaccttaatttgttttacagatcttctgaaacccctgccccatcatccaaaacaaaactttctagtatttcaaaggagtttagtaagactctggtattataaattcaaactcagtactgccatctgttacattttgtttaaaaattgaatcattttcctgctgaataaaaatatcttcccaggtcattggcttgttctgagtagatgtagtggtccctactggaggttcttttccagtgtcaaccttatacccaataccatcatccttcattgcaggaatagtgcttgatctatcggaaagatatgcatattgtct

SEQ ID NO: 14210 - DNA, 8835 bp, Homo sapiens
gaaaacctttttatatttctgtacaaacttttcattttaatattgtgacaccaccatgcaagttctcacacaatatccgtgtcttgtagagtagtgaagtgtttgttaagtagaaaaacacaccagtgtggtacccagtgaaaggtggtgtctggagagtcagtggtttctggaactctggactgtcaaccaggaagtgttgaagtgactgaaaaattaaagcacatgggtaatagcatgggcagagcagagactgagacgatctatgtccatgccaaaggaagcatcctagtaagtttctggctatggcaagatgacaaaactcggtgtacgttttatctggatcacttttggagcactaaagcagataaccaactttgtgctaacatacatgtgctcaggagagcctgattttaagactgacttcaccccattgctcttgtgttccagaaccttcaaggaacatcacctaccagatccaagctttgccagcttagctttcctcatgatcagctcctatctatctatcaatcaatcagctgtcagttccacccatgtgcccaagtgctcttcacaccttcacacctgcaatgctttcctgtgcagcctaccttggaggtcccactcaatgctccacttcccttccagctcctttgaagactcagtcacacatgaaatttggcatttaactttagtaatatactcacaagtgtgttactagtgcctacctcaccttcaccagcctggagaaaaggctattttcagggtaccactgttgtgcagctgagccaagtcttcctgctctcaatcaatcaccctgctgctcttggctgccctgcatcacagccctctggatgatatgctcattgagggaggggccaactatatacaaaaaaatacacgtttgctgaaattactcctagatttctagatgagtatgtaaatttttctgctcccaaagctctggcatctagtttgagtcaatctgagctctataacaggtgaagacatcatattagtttgcagactagactatcaataggagaaataggacgaaagcagcactttaaaaatggatattaaactaccacgatcttgagcaaacatctttatttaagaaatcaaatagggtaaaaattatgcaatttcacacaaggatacaagacaaagcttagaattacttgctcaaaagttactcagaatggaacaaaattgttcaagtgctcccaattagcacaggctgtattacttgcttttcaatggacatttactattttacattaagatctacttataggaacaaagagacaattcccagccccctctggtgtatcacctaaaagactgaatacaaatgttaatgtaatccaagcttttctttgacaacaatactaaaaattgccttacaattttttacaagtacgagtatcaacagtttactgtctgagggaaaggaaatataagaatataaagtgacagaagcaacacacttcactgtggcctgcaactgctcccagcgtcctattttataaacatgatttgggttctcacattatagcaggatcactattcctagcctctggtggaagcagacatgtgacacttagcactgcacaagtgtttctttggcttcttgagtagtgctgtgtatactgcctatacatttttataacatctctaaatgcataatgtcaacgtatgtgctatcacatttcactcccaactgcagaatattttaattttaaatttatctaccaaatcttgactatgacatttatttttgggttgttacattaagatcaacctatctgggccgggcacggtggctcacacctgtaatcccagcactttgggaggctgaggcaggagaattgcttgaagtcaggaggcagaggttacggtgaaacaactgccattgcactccagcctggacaacagagcgaaactccatctcaaaaaaaaaaaaaaaaccccaaagatcaacctatctgaattgggtaagtcaaaagcttattcctggccgggcacggtggttcatgcctgtaatcctagcactttgggaggctgaggcgggtggatcaactgaggtcaggagtttgaaaccagcccggccaaaatagcgaaaccccgtctctactaaaaacacaaaaattagccaggtgtggtggtgcatgcctgtaatcccagctactcgggaggctgaagaaggagaattgcttgaacccaggaggtggaggttgcagtgagccaagactgtgccactgcactccagcctgcacaacaggagcaagactccatctcaaaaaaacaaaaaacaaaaaacaaaaacaaaaacccacaaaaaaccaaaaagcttattcccaatttttaagtaaaaatatttcatggccgggcgtggtggctcacacgcctgtaatcccagcacttcctgaggtgggtggatcacgaggtcaggagttcaagaccagcctgaccaatatggtgaaaccctgtctctactaaaaatacaaaaattagccaggtgtggtggtgcacgcctataatctcagctactcgggaggctgaagaaggagaattgcttgaacccgggaggtggaggttgcagtgagccaagatcgtgccactgcactacagcctgcacaacaggagcaagactccatctcaaaaaaaaaaaaagcgagcttattcccaatttttaagtaaaaatatttcatggttgggcacggtggctcacgcctgtaatcccagtactttgggaggccaaggcgggcagatcacgaggtcaggagttcaagaccagcctgaccaatatggtgaaaccctgtctctactaaaaatacaaaaattagccgggcgtggtggcacgcgcctgtagtcccagctacttggaggctgaggcaggagaatcgcctgaacctgggaggcggaggttgcagtgagccaagattgcgccactgcactccagcctggcaacagagtgagactctgtatcagaaaaaaaaaaaaaaaaaaaacatgattattgataatgaactctttataaataacactgttcacaaggaaataccaattgatctattgatacgtgacatgagacagaatgtactatttttaaatataaaaggaatttcattaggtttagataagctgagaatacacaaaagttttccaggctatttaatcaagtaacttacaatgtacacattcctgagtatacaccattgtggtgacatcatttattttggaattttctgcattcagcttaaaaggtgtttcttcccaagaaactgaacttttctgtcaaatgcacttgatcgaataggagaattgggttcataaaatggattcattgaaaactaggaaagaagaaagtattagtgaagcaaaaaagctgacaaatcttaagtttctgaaaggaaatcattttaaagttttaaattaaaaaccaaagacattccaaagtctaaagaccacatttttaagttttattgaaaatgctgcattgttaataacatcctcttaaggaaatttttattttggtgttttggttttgagaagtatctgtggcaaaactaatggcagtatgataaatgttgcctgtgtcagttaactttcagaatttaccgtgtgtgtgaaatactcatattcattataaataaatggattaatctctatggccctttggctacataaaacaaaaaaatctgccatgtgctcagagttcagaaaaagctattcttgtgtggtaatcttttaacaatcaggtttttaatactctcctttaacacaagactgctaaatgatcagcttctcaaattagtgtatcataacgcatgacagaaaatcattaaatggaatcactaatgaggaaaggcattgctgatttttataccttaatcacttgacattgttcatctttataagagggctaaatattacttactacctctgactaggaatactgttaaattgtattactgtgctgatatgcaagaaattctgtccaaatacagaacttatttaaattattaaaaacatatgggccaggcatggtggctcacgcctgtaatcccagcactttgggaggccaaggcgggtggatcacttgaggtcaggagtttgagaccagcctggccaacatggcaaaacctcgtctctactgaaaatacaaaaattagctgggtgtggtggtgcacacttgtggtcccagctacttgggaggctgaggcaggagaatcgcttgaacctggaaggcagaggttgcagtgagctgagatcacgccactgcactccagcctgggtgacagagcaagactgtctccaaaacaaaacatactattgttatcactgcagtgtaaccatgacgtcctattattattttatttttcaaaatcaagaaatgcaagtggcgccattcttcttgagtggctatttgatcatataaaaatcacttcctgccagtttatgatctctattgcactgtaacttatttgtaaagtagatggaaacattttagattaaattatgaagtaattttcccttatataggctgctttcttgctgtctttagggatccctaataaaatcagctatgaggacaacaaggtgaagaatgaaaccaatttaccttcacaatcatctaaaggtaactaccatgaagttgtgttcctaaatacatattcacctggctgtgaagacttacctgcggagggagttgccagagatagttctgatgggggaaagctagtctgaaaggtaaactgcagcctaagggagttacttcaataggccagtttcctgacaaaggtcgaatcctttctcatcagaatttaaaaattatagaacataccatacctttatatataaatcataaacatcagtaaagaagttctttattccatcttcttgtcttatgtcatgaagcataataaacctcatatgtgaaataattaaggcataatctttcttagaaatgaaaaacaaaaagcaaccagttcgttgatacagtattcttcaaattagtcacatgcagtgtatttgtgatggaaaagttgaatatataaactgggtttaaaattagcttagttttatcataaagagaacataagctttcaaagttagaaaataactgtaaaataaagtaaaatcacccttgatagggtccagataaactctttttgtgtatgagacttagttttaaaattagctattaaacaaaatgtttttcccccctaaaaaaagaaaagtagccccataaatggaaacttacattttcacctgactgtgaagtctacagactcagagcctggcatctatgttccatgttcttctggtttgtgagcccaaactttagttagttacctttactaagaaggtaaggatatgccccgcagtgacaaatgccgacacaaaccactcgttgaacttgtccacagttttcaagtacatgttgttcgatagccacatgttctcatctacgaggtcgagagcagcatgagctatgaactggttcagatgacgatggtcgtcctagatgacagtgtgagcaaccacagattaacatttgcatatggcatcgagaatgctgacatttcattctgtaaattctatagatggttttcttgtggggaaaaaacagtttgcttttatactttgttattgtcatgagacttataaaagatctgttttcatattatattctatttttaaatttgatatctacatctcaacagaaacagccaattaataaatgaaatgtgtatatagaggatttatacaaaatcatttattgaaaatctttttcatataaattttttttcatgtttcaagaaggaagttaccgaattctgtaaccatctaaacatgtaaaaaaaggatactatgttaaaaaaaaaaaaaaaaaaaaaaaaaaaaaacaagatcctgtggagaagaggtgccattcacactaggcctcaaggtctgggaggaaactgagagggcggggcttcctgcacagtggcaccaggtaagcagtagagacagttgaaatggcgcttataacggcctgccagaggcctctttccagtgcatggagcttacatgacagcgggacctaggagtagtgggaggtgatgctcagccccagctgtgagcagtcgcctgtgtcaatagcaggacacagtcctgtcagagctgggagtgtccttttcctgggctgaaatggcttaagtgaacagaaggtgggactgtctgaccataatgtgaagacggaattcagaacttggaatgcagtcttactccaatgtagttctttgaaaatacattttttggccaggcgcggtggcttatgcttgtaatcctagcactttgggaggctgaggcaggtggatcacctgaggtcaggagttcaagaccagcctgtccaatatggtgaaatcccatctctactaatacaaaaattggccggctgtggtggtgcatgcctgtaatcccagctactcgggaggctgaggcaggagaattgcttgaacctgggaggcggaggctgcagtgagccgagatcacgccattgcactccagcctgggggacaagagcaaaactccgtctcaaaaaaacccaagccatttttcaaagaatacctgttatgggttgaagtgtttcctctctaaaattcctttgttgaagtcctaagcaacagtacctcagaatgtggccttatatggaaagagggttgttgcagatgtggttagctaagatgaggtcacactggagtagggtgggcccctaatccaatggactggtgtatttagaaaaagggaacatttagagatgcacacagggagaaaaatgccacatgaagactggagttatgctgccacaagccaaggaactcccagaagctgggagagaggcctggacagacccttgtctttgtgccttcatagggagcatggccccactgacaccttgatttcagatggtggccctcagaactgagacaataaatttctgctgtcccaagccactcagtttttcgtactttgttacaacagccataggaaactgagacggcttccttgccaaggaggctgttctcatgcctgggctggaggagggcggcccgttgccgtggaatcccatgcatagttaaagcatgttttacttcactcatgttgccatgacaaagctaagtgaatccttagagaaatggatgtttttgtgtctggctcacagcagtgttttcttttacaatgatgatcaatcctgaagaattaggagcaaactgaaaacgctttaagaaagtgagtggtagcaggagaaagaactaaaatcaagttatgcaacaaagtatttttatgtgtgctttgtccaacacaagggcagtggagtgcacagaaattacatacaagtagctgcatcccacaaagcagtactggtacagagatacctcaaaaacaagttttaatgagtagtgttctcataatatgagaaaataatgtcacaactccacctcatagagaatcccgtaaacaaatgcctatcttattttggtggcaaggcctgaatagttgaaaaataccatatattatgcattacaattaacttaaaacatcaattccttaaaggacattaaagccaatttttggaggttgggagaaacatagcaaacttgtcagcaatttattagaaacagaaattggaaagaactgggctcttctcgtgtcaaaactctacaggtctgggccaggtgtagtggctcatgtctgcaatcccagcactttgggaggccgagggcaggcagaccacctgaggtcaggagttcgagaccagcctgggcaacatggcgaaaccctgtctctactaaaaatacaaaaattagcctggcacagtggtgcgcacctataatcccagctacctgggaggctaatacaggagaattgcttgaacccaggaggcagaagttgcagtgagctgagatcgtgtcactgcactccagtctgggcgacagagcaagactctgtctcaaaaagaataaataaataagatccaaatggttttattttaagcatttgggatggtaatctttcttaaaatatatggtccatttccttgtctcaaaaaaaaaaaatactctatgggtctgaatggcaatatgtcctcgagctaagcttggtttttggaaccattcttgacaagcaagttgggtggtatcacctctggtgctgcttttgagcttcctgtgtatggccaaggtgtcactggggaggggagcatacaggctcaacccagccaggaagtgctgcagaaggcccctgaagtgaggtgctgcagacccagtggcagcaggaagacagggaagtaagggtcttttctaacccagtaggtcctgatgaaaaacatgattcatgaaaacagcctggactttcatggtatttcaaggcggcaatccactacaggtgaactatgtctttatgtgcttaagcaacagcaattcatggtgggtgacatagtgaactgagtatgatgggaatgccagagcgtcatgctagtctgtgctgaactaaaggatgaataaacatctccaaggacataccctggctggcttctatcagtctgtgggctcctgagcaagcctcatttaattgtggtggatttcagttaccttatctgtccagatcttccagttctaaaatcatattataccatatcattacaatagcataaaaattcttacgtactttggattctgccttcccagctggcaaaaactccatttcaaaaactggattatcatggtggccaacaattacaaagtagaagctcccagacatggtcttcaatatatggctcct

SEQ ID NO: 14211 - DNA, 492 bp, Homo sapiens
caaattgtggtcttttgtggatgaagttcatatgctgtgtggttggtgactatctgattctatggaggctaaccaaagcctagactgagtgtggatgagaccctcaactggggagtgatggggatatcaaaggacatgctgggtgagaggagctgactgtcatgtagggagtgaaccactgcccccagcagagatacagttcggttttaagaaaaaaggcaaggccaggcgcggtggctcacgcctgcaatcccaacacttttggaggtcaagaggtcgacaccatccttgacaacatggtgaacccggtctctactaaaaatacaaaaattagttgggcatcgtgcctgtagtcccagcttctcggaaggctgacgcaggagaatcacttgaacccggaaggtggaggttgcagtgagccgagatcacatcactgcactccagcctggtgacagtgagactccacctcaaaaaaaaaaaaaaaaaaaaaaa

SEQ ID NO: 14212 - DNA, 4787 bp, Homo sapiens
ggttatggtttaactcagcagaatttgttgaacaactacgacatgctggggatcatggtatgtttagagacacaaaagtgaattcaaaatcttctcttcaattattttatcatacgttccctttgtttctttgctatttgccaagccctctatttgtgtttccaccttaatgccttcacatgtgctctttcttatgcctggaacacttcctgcaaatatagatatgtctctttcactttcttcattgaggtttttgtttaaatgtcatcttgtataaaagcctctcccttatcaccacatataaaaatgagtcactgccaccctccatcccaaaactttctaatatttttaccttcccatatgtttttattcatagcacttatcattattggtatcattcattgtttacttcctgattattcttcccaagagagtataaattgttagagattaggaactttgatttattcactgctgttatctcccgtgcctgaaattatattcagcacatagttgaaaggtattcaaaaaatttgttaaaataatacattaatgacatatatatatgtgtgtatgctttccttactgatgtaacctactttctatagttcaccattcaagtgtttttcattattattatgttctgcacagttttgtcattagtcacagtctagtgtttaatccttatattttctctctcttctttaggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaattgttttggcaacattctctatgttattcttattcacatgatcctagaactttatgtgagaactgaatagcagaagatatattattaaatagtttttggaagttgtgctgttaagcaaatgtaaagtcaacagtaacaatgattaagaaaggaatataatgagttcaaagatatctatctgatatattttttatattcatcatgaatcggggtagtcttgtaatttatctaacctttttgttgtatgggtttatagtggaaagaatcttaatttaaataaaaagaacctgaagagataattcaacaaaagtagagaatatgtttgagcttgtcagagaatttaagtatcaaaatactagagagatacaccaaggatatttgaataaaaaaaaaatttgtagaacacaaaatgcctatcaggaaacccaaagcaaaacagaacaaaaagtgaatacatcgttttaaatgatgattttgccatctggtattttattatcataatttgaccaccagtgcatgaaaatatattaaagttcattagccttctgctcttgatttaatagtgaactttaaaatatattaatatcataaaccagcaaataaggagaaataaactgataatactagattcattgggatagttttcccttttggagggaaagtcacaatttttctccatgatcccccattttttgtaaacactggaataatttacaaggataactttattgtagcgagagcaaatcacatctggagtgagccttgttttcatgcaacattaccataagaccattggagtaaatgtttcaaacaaaatgtacttcatgaaattatagaacataaaaatatttatgtgcatattaacctgtattatcccaggagggttaatgaggccccatttcctgcacaaaacaaatgtaggggaaaaaatgggtgctgcattagctttttaaagtcaaacaactatcacataataattccttgatatgcaacataaagtacctatggccacatatctaagttcctttccttgatgtcattagctataaggagtgagtaatgtgaaggacaaaataagcattatgaatacagagacataaaattccactgtcccttccttttctgaaatactctgggaggtattctgatatttttaaatcccccaattttcccagttgatatctctagacttcaagcaactgaaatattataaaaatgcattagtcacaaaagatttattttcttacatcacaccaggctttaagatattttctgccatgccttgcctttagtatcaatattttaaaaatttcactgtaattttataactgcctaataacaaactgaaaacagaacttctgagtttccttatcagaaagggccacagaaaaggccttaagaaagaaagattcacttacttctgcaaacttggcaatccgtaatttaactttaatttgtattttatgcatgaattttacttgtaaagacaaaattaaatttgcttcccctacatcccaactccaagaagtcacaggaatagactctttctaatagtgcagtgaaatattttttcaaaccataaactcacatatatatatatatatatatatatatatatatatatatatgtaccttgtaaacaagaggttaagaaattttatagcacattttaaaattattttcttcctcaaatctatcatgtggtaacttaatctttaacagactttagggccctaaactaaaattataagagctatttcatttgcttgttgtactgggtaattgtaagaatcacaaacaataaatcatgaaaatcctttctgggtttgtggtttctaaaggaaataatattgagcttttgtattttgtcttttaattggctccctggtatcttcagaatgatgtctagattcttcagtctggacccacctactcttctcacattatctcccatcactgttgtcacaaaccataccctatagctaaagattgctactttagtttattacattcagaactttcttcactttgttcacctgttgcccatctttgttctatcatacctgaatggtataataattctaaacaactttcaaggttcatctcatctgtcattctttgttgaagcttgcccttatatcctctcttccccaaacctaaaagtaaaactttctaccactggggcttcagatacttttaatactacttatttgaatttcattatttttattatagtttattattgtcttcatagctgagtactcttaaaattactgtttattataagtgaatgtcttacagaacaaactcaaagtcaatgcttcttttgcatgtgaataatcaagctatttttttgtcatcattactttagtaagtaacattattttatatgaagaatagagtgtatatacataaacccatgtgccagctgccattgcactgcctcacattttcctttagatgtttgagcatagttttaatgactgtttgaaatctctgtctcctagttccaaatatgggtcatcttggagttggtcttcattggtgccttttctcttcagtatgagtcataattttcctgtttctctatatgcctagtaaattagaattttattctagatgatgaataatgtgtggcagagattctggattctgttacattccatcaaagagtattgatattttgtatatacatttacaaatgtacatgtacacaataataaaaataatttttttctcagacctgcctgcaatcatgaa

SEQ ID NO: 14213 - DNA, 4787 bp, Homo sapiens
ggttatggtttaactcagcagaatttgttgaacaactacgacatgctggggatcatggtatgtttagagacacaaaagtgaattcaaaatcttctcttcaattattttatcatacgttccctttgtttctttgctatttgccaagccctctatttgtgtttccaccttaatgccttcacatgtgctctttcttatgcctggaacacttcctgcaaatatagatatgtctctttcactttcttcattgaggtttttgtttaaatgtcatcttgtataaaagcctctcccttatcaccacatataaaaatgagtcactgccaccctccatcccaaaactttctaatatttttaccttcccatatgtttttattcatagcacttatcattattggtatcattcattgtttacttcctgattattcttcccaagagagtataaattgttagagattaggaactttgatttattcactgctgttatctcccgtgcctgaaattatattcagcacatagttgaaaggtattcaaaaaatttgttaaaataatacattaatgacatatatatatgtgtgtatgctttccttactgatgtaacctactttctatagttcaccattcaagtgtttttcattattattatgttctgcacagttttgtcattagtcacagtctaatgtttaatccttatattttctctctcttctttaggcatggaatgcaacttgcaaacactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaattgttttggcaacattctctatgttattcttattcacatgatcctagaactttatgtgagaactgaatagcagaagatatattattaaatagtttttggaagttgtgctgttaagcaaatgtaaagtcaacagtaacaatgattaagaaaggaatataatgagttcaaagatatctatctgatatattttttatattcatcatgaatcggggtagtcttgtaatttatctaacctttttgttgtatgggtttatagtggaaagaatcttaatttaaataaaaagaacctgaagagataattcaacaaaagtagagaatatgtttgagcttgtcagagaatttaagtatcaaaatactagagagatacaccaaggatatttgaataaaaaaaaaatttgtagaacacaaaatgcctatcaggaaacccaaagcaaaacagaacaaaaagtgaatacatcgttttaaatgatgattttgccatctggtattttattatcataatttgaccaccagtgcatgaaaatatattaaagttcattagccttctgctcttgatttaatagtgaactttaaaatatattaatatcataaaccagcaaataaggagaaataaactgataatactagattcattgggatagttttcccttttggagggaaagtcacaatttttctccatgatcccccattttttgtaaacactggaataatttacaaggataactttattgtagcgagagcaaatcacatctggagtgagccttgttttcatgcaacattaccataagaccattggagtaaatgtttcaaacaaaatgtacttcatgaaattatagaacataaaaatatttatgtgcatattaacctgtattatcccaggagggttaatgaggccccatttcctgcacaaaacaaatgtaggggaaaaaatgggtgctgcattagctttttaaagtcaaacaactatcacataataattccttgatatgcaacataaagtacctatggccacatatctaagttcctttccttgatgtcattagctataaggagtgagtaatgtgaaggacaaaataagcattatgaatacagagacataaaattccactgtcccttccttttctgaaatactctgggaggtattctgatatttttaaatcccccaattttcccagttgatatctctagacttcaagcaactgaaatattataaaaatgcattagtcacaaaagatttattttcttacatcacaccaggctttaagatattttctgccatgccttgcctttagtatcaatattttaaaaatttcactgtaattttataactgcctaataacaaactgaaaacagaacttctgagtttccttatcagaaagggccacagaaaaggccttaagaaagaaagattcacttacttctgcaaacttggcaatccgtaatttaactttaatttgtattttatgcatgaattttacttgtaaagacaaaattaaatttgcttcccctacatcccaactccaagaagtcacaggaatagactctttctaatagtgcagtgaaatattttttcaaaccataaactcacatatatatatatatatatatatatatatatatatatatatgtaccttgtaaacaagaggttaagaaattttatagcacattttaaaattattttcttcctcaaatctatcatgtggtaacttaatctttaacagactttagggccctaaactaaaattataagagctatttcatttgcttgttgtactgggtaattgtaagaatcacaaacaataaatcatgaaaatcctttctgggtttgtggtttctaaaggaaataatattgagcttttgtattttgtcttttaattggctccctggtatcttcagaatgatgtctagattcttcagtctggacccacctactcttctcacattatctcccatcactgttgtcacaaaccataccctatagctaaagattgctactttagtttattacattcagaactttcttcactttgttcacctgtagcccatctttgttctatcatacctgaatggtataataattctaaacaactttcaaggttcatctcatctgtcattctttgtataagcttgcccttatatcctctcttccccaaacctaaaagtaaaactttctaccactggggcttcagatacttttaatactacttatttgaatttcattatttttattatagtttattattgtcttcatagctgagtactcttaaaattactgtttattataagtgaatgtcttacagaacaaactcaaagtcaatgcttcttttgcatgtgaataatcaagctatttttttgtcatcattactttagtaagtaacattattttatatgaagaatagagtgtatatacataaacccatgtgccagctgccattgcactgcctcacattttcctttagatgtttgagcatagttttaatgactgtttgaaatctctgtctcctagttccaaatatgggtcatcttggagttggtcttcattggtgccttttctcttcagtatgagtcataattttcctgtttctctatatgcctagtaaattagaattttattctagatgatgaataatgtgtggcagagattctggattctgttacattccatcaaagagtattgatattttgtatatacatttacaaatgtacatgtacacaataataaaaataatttttttctcagacctgcctgcaatcatgaa

SEQ ID NO: 14214 - DNA, 178 bp, Homo sapiens
tggcaggtgtccctctgggatgaagcttccagaggaaggagcaggcagcaattttcactgttctgcagcctctgctggtgatacccaggcaaacagggtctggagtggacctctagcaaactccagcagacctgcagtagaggggcttgactgttagaaggaaaactaacaaacagaa

SEQ ID NO: 14215 - DNA, 178 bp, Homo sapiens; identical to SEQ ID NO: 14214

SEQ ID NO: 14216 - DNA, 4327 bp, Homo sapiens
atctcccgttttatgctaataatcttatagaaatttaggttaaatacagaccaagagccttcaaagccctcagtaagttgcaatacttaatttctgcaacagctaaggactgcaaaaccccactctgcatcaactgaacgcaaatcagccactttaattaaggtaagccctaagtagaccaatggggacttaaacccacaaacacttagttaacagctaagcaccctgaatgcaactgggcttcaatgctgacttctgcccgccgccgggaaaaaaggcgggagaagccccggcaggtttgaagctgcttcttcgaatttgcaattcaatatgaaaatcacctcagagctggtaaaaagaggcttaacccctgtctttagattaacagtccaatgcttcactcagccattttacctcacccccattgatgttctccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgctcgcatctgctatagtggaggccggcgcaggaacaggttgaacagtctaccctcccttggcagggaactactcccaccctggagtctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccactaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccaatgctctgaaatctgtggagcaaaccacagttttatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatgacccaccataattacccccatactccttacactattcctcatcacccaactaaaaatattaaatacaaattaccacctacctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctt

SEQ ID NO: 14217 - DNA, 389 bp, Homo sapiens
tttaattatactttaagttttagggtacatgtgcacaacgtgcaggtctgttacgtatgcatacatgtaccatgttggtgtgctgcacccattaactcgtcatttaagattagtttgtggctctaattttcttgactattgttttaagctattattaccttcttacttatcagggtgctcatctacttcttgaggctagccaggtggctggaattttccttggagggactcaagagtttcctttatttttcatgccttaaatgggtctgttctccctcttcaaagctcaagctcttaaggactatgctattgttagatttttcgtattggagcagtccttccctcctactcaagaacaccccttcttcagacagcctggctgggtcttc

SEQ ID NO: 14218 - DNA, 10166 bp, Homo sapiens
gctgaggagtacctgtccttcttccagtttggaggccagagtctggaccgagccctccggtaatgtctttgggccctctctggggaggctgtggaggatggcatggggcagtggcaccagcctgaggctggattctgattggccctaagctcccgggctctctccttgaccctggccctcctttgcaggagcttcctccaggccttggtgctcagtggggagactcaggaacgggagcgaatcctctaccagttctccagacgcttccaccattgcaatccggggatcttcccctcagtaggtagggaggggctggccctgacagcaaagcagggaaactttggggtgcccatgtctgcttgggagttcagtaggtgacagtgaactggtgggagtgtgttgggggctgtggagaatggaagcattccaggggttattcggttaccccacgcagtgtgggcagaggaaacaggagccctggttccaatgagctttctctccacttacctatctctggggtagattctgtacacaccttgacatgtgcaatcatgctgcttaacacggacctgcatggacaggtaagacggtggagagagtccctgtgggaactgaggctgtaacaaggggtgcggggaggagaagaccagaggcctgagaccgggcagggaacacccctgagggatgtgggcctggggagctggaaagggttccatggttgctggctgggaggttattctattgggatggggtgtgtgctcgagtcatcccacttctccgtggctacagaacattgggaagagcatgagctgccaggaattcataaccaacctgaatgggctgagggatggcgggaacttccccaaggagctgctgaaggtatgtgccacggggtcttcttatgagcctcatgtaggacctggagccttggttctttgttccaagggagatgctgagcttgggactggctttgccaaaatatccttgagagaacaggacttgtttattgaagggctagtaaaagtgtattccctggcgggcagcatcagaagcatcttggaatttgttatccatgcaaatctgcaggctccctgtgctggacttattgaatcagactctctgagactgggacccctaaaatattttcttaagttttcaagtcattcttaccccttcaaagtctgagaagggcaaagctacacatggtgaaagtctggagctcagacttgggagcctggtgttcctgggtttgaattctagtcttgggcaatttgccccctcttggccaactcaagttcttcctgagagtattaaccacttaccatgccattatcaagatgaaatgaaatcttccaagtgctcagcacggtgcttggcacatagcatgtgtgtcataagcaattaaaatcatttgctgtttcatcacagtcacgcatcacttaacgatgaaggtgtgttctgagaaatgcatcgttgggcattttcactattgtgtgaacattatagagtgaacctacacaaacctagatgtacagctcactgcacaccagggctatatgggatagtctattgctcctgggctacaaacctgtatggcatgctgctgtacttaatactgcaagcaattctaacacagtgctgtatttgtatatctaaacatagaaaaggtacaataaacacatgatagaaaagattaaaaatgatacatctgtataggacagctccatcacaaccttacaggaccactatcatgtatgcagttcatccttgactgaaccatcatgatgctgttatatggtacatggctgtacttcatgaacatttactgaacacctactatgtgccagactttttgctaggcaccgcaagagctatagaagcaagcgagataacatctacgttaatatgtcaaacttttagtgcatcattcattcatttactgcacatttattgtggggattggtcagccagtttcttctccatcagatccctcccagtagaatgccatgtaggtaattcatttctcctccatgagaactagttaaggcctcagtaagcatgggcaggacagggacttgtctgccctggtcatcatcttttttttttttttgagatggagtctcatcctgcactgtcgcgggagtgcagtggtgtgatcttggctcactgcaacctccgcctcccgggttcaagcaattctcttgcctcagcctcctgagtagctgggattacaggtgtgcaccaccacgcccagataattttttgtatttttagtagagacagggtttcatcatgttggccaaggctggtctcgaactcctgacttcaagtgatccacccgcctcggcctcccaaagtgcagggattagaggtgtgagccactgtgcctggcaggtcatctttatgtctctagcacccagcatagtgcttgttgctgggaaatactccagaaatactttgttgcacggatggatggatggatggatggatggatggatggatggatggatgcttgcttactcaaggaggaagggcacctatgttgtgggtggaggaggcaggctgtacacatgcccctatcctacctctgccagacaaagagactttaggctccacagccctgaggctcccctgcccacctgtgtgcttctgttccaggccctctactggtctatccgcagcgagaagctcgagtgggccgtgtgagtgagactccctttcccctctccctctcacccctctcccctgtctttggactgtcctccctctgtcacccacccgagagttagagaaactcagatagtgctccccttggagtgaggcaaagccagaggcagggctctggggagagagcatagaggagcccaagtaataccggagggccagaggtagtggggcgtggggtatggcagaattttcaggaattgatgggttcactgtgaaggaggactccttgtggggggtcctggggtgtggcttcccaggaaaagagaggttgctaaggctctgggaggcaatggatacctcccagttctctttgcatagtcagcacttccagcccgattctctgatgttcagggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagagtgagtgtctgctgcccacaaacagggtggcgtgctgggagcagccctgctcagggacctgtgccgatgcatgcacaggtgtgcagagagacagcccgcgttgaggacaggcagccagcccatgttccttcctcagtgcgtactgaacagtgaccatgtgctggatgctgtgtgaggcactagagggtaggtaggagaacccagacaaaacaggcctagttattcctgggccccagagtccctgtagtaaggtagagattagacaagtgtgtcaatgtctgcgaaaaaaatgtagcaagagctgagtgtctaggggctgaatcaagtgaggagaaaaaggtttttggttttgttttggaagcgggatgtggctacagggagaggtaaggcttctggtaagtgatggtatctgcgctgaactttggaggagaagagggtctggaatttggaagctgggcagagggcatcccccacagagaaaacagcaagccgagtttgctcagaacatggggtgtgtgaaagggaggtacacttgaggcaaaattgccagggcctgcatttgggccttattccacaggcagctgaaggcttttgattatggcaccaacatgtccagagtggtgatctcagcagactaatgtgcaagcacagattgaataggctggggcgaccaggatgggaactagcattggctgtgaagccgccggggccctagggctgccttttgtccaaggagcttagaatggatcttaccacacaagaccagggtggagaggtagggggaaaagagggcaggtggtgctcagagtggggtacacagggaagggcaccccaaagctgggctctgcgcccttgagcccctctagatgggtatgcaaggtcaagatcatcctgcagggactagaaagctgtctgggaggagctgtgtttgtgcctgggtgtttgccactacttggggtagtgggtgtgtgtttggagttggagagaagatgatatgtatgaatatctatatttggatgtgagtggttctatggttttgtttccagcgggcattgcctgtgtgtggagagactctatatgtttgtttacgattgtatgtgttttcttgtgttggcatgttctgcatttgtgtgcatcctggtgagagactggaggtggtgtgagggacagggggcatatgcacacttgcgtgtgtctgagtgtgtctggatgctggtgcccccacctacaacatttgtgttctgttcctggaacagcgccatggggcaagcgtggctggaagatgttccacaccttactgcgagggatggttctctacttcctgaaggtaggaaaggagccaacacccctgtcagaatgggagactgagagaggcccagaacagtctggagggtgggcagctgatgataacctcttctctgagcccctgtgactggtagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcaccgtaagtccctggggtgggagacgtgtggcaagccttgcctgccctagttctctctcccctgaccctgctgacacctgaggcttgtggggcccagggggtccctggtgggaatggccgtatgatcagaaattcttagaaagcggcagcaggaagaggagctggggcccagggatgaagcccaggcatcgcctacttcctccccatccttggccaactttgccagcacagtatgccttttccttgtcagtgggataaagcctcccagttcagaacacaggagttccgggacagttgctaatgattgaccatatctggcatttgttatgaaatctgtcaccttctcagattgtcctctatagtttttattttttatttttgagacagagtctcgctctgtcgtccttgctggagtgcagtgactctcacctcggctcactgcaaccgccgcctcccgggttcaagcgattctcatgcctgagcctcccgagtagctgggattaagaggcgggccaccgcgcctggctaatttgtgtatttttagtagagacggggtttcaccctgttgaccaggctggtctcgaactcctgacctcaggtgatccgcctgccaaggcgttgccaccgcaccgggcctccaaattttcctctttattgataagaaatgccacggtcagaggtcgggtgcccggctagtggcagggctgtaactatgggaggctgagttctgagcagctggccagctgtgcaagcagccacaggagggggcgggaggagggtgacaggacggactctgttgtcccgggggaccaacgacctcctttgccccagcactgccaaggagatgagctcctggatcgcgcgcatcaacttggctgcggcccacgcactccgcgccgcccttccccgccgctgtgggctcccagcgcagattcgtgcggcccatcctgcccgtgggccccgcccagagctccctggtacggcctccgggaaggggtggggtccggcggaactgggaatgtgcacctggagccccaggactaactcggggaggctggaggcgggctgcgcacttggcctgggaaccgaggcggccaggggggcggcgcgcgtggcccggaaagcagcggtggggacgctcgagacagcgcccctcaccgcccgctgctcgcagaggagcagcatcgatcccacgagaactgcctggacgtgcgcgacgacgactgctgaatctacagaggaacctgccggaagggcggggccgtggccgcgagctggaggagcaccgctgcggaaggagtacctggagtacgaggtgagcggccgagcccacctcaccgccgctgcgcagcgccctctccgccctctcgtggccgcctcggtccctgcagccgtcactgccctgaccgcgccggggcggggagaggcgcttgcgtgcgggcggggcccgcgtgcgccgtctgcaaaggggcgggggctcccacatggacacccgcgtgcacgggcgtgcacaaagagtgtgtgtccccacgcacttaggcctgtcgcctctcgtcctgggggcacatagcagctgcttgtctggaaacacccatagcagatgttattttacagttttcttttctcctaagagtatatttggcttttcccaagttgaagggaaaactgtatttcagctcaactgttccttctaatacctaccaaatattaataggtagtatggatggagcttgtcttccttgcatggattgtctcattcaattaacagctctgggtaggtcctgttatcctcattttacagatgaggaaactgaggcacagagaaattaaactactcttccaaatctggtaaatttacatgctgctctaaatgccccgtttatggtcttaactaagaaatgaccgtgtttttttgtttttgtttttgtttttgagacaaagtctcgctctgtcgcccaggctggagtgcagtggctcgatctcagctccctgcaacctccgcctcccaggttcaagcgattctcctgcctcagcctcccgagtagctgggattacaggtgtgagccaccacacctggataagttttgtatttttagtagagacaggggttcaccatgttggcaaagctggacttgaactcctggcctcaagtggtctgcctgcctcagccttccaaagtgctgggattacaggtgtgatccactgccccggccagtaatgactttgttgactctacagcccatgttgaaatgttttatcccttagtctcccccaaccctcacccatccacccacactccccaattctgctttggtgtgacgtcagttcatctgggatcctaacactgggtgcctgcttcagggatcctgggtgcctgcttagggtgagggcccactgggcaggaagggtaggtgaatgcaatgtgaaaatagagggaatcagaggccacccagaggcagagaccaggaagtgggagtcaacatcgcctcctgcctgtccccgctgtgcccgcatgcagccctctgcctgtctttcaaggtcccaggctatcccttggcttgttggttgtatccatggctgtgaactccccacttctcagaggcctcagggtgtggctgtgaggacccaacctcttcctcccactgaccagctgggacctttaacaagtcaccagccctcccttccgcaatgatttgtcccctcccagggctggcatgaggatccaatgggatggagggtgaggaagcactttgtaaactggaaaccatatcccaaggatgctagctgcaggggcctcaggagtacagtgttaagtagatgagggtagttagcatcatgctccacagatgccaattgttaaaatgctatttagacccaattagggctgtacagatgtgagctgtttgtgtgtagggctgcaaagatctcaggcatagtgggtgacacatcttttagtgcctcaaagatggaacatggcatagagatgttagttacagcactccaaggggttggttattattagaacagggctgggctgatatgtgtcattataatactatccagaggtgtgctctgcagtctgcttatccaagcattatactgacactcacggttggtccagccctctttctgtcgaggtctgtatcgccatagcttcatgtacctgtgagctgtccctcacgattctagcctcctcccaacctggagccaggatggtgctaaggtggtggggcctgtgtgttgcagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccaaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggacaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggcggaggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgacaa

SEQ ID NO: 14219 - DNA, 249 bp, Homo sapiens
atctcccctcctaacttttcccccataccctcactgtatctgctgcttactctcagtcatggtcctcatgctctccacacccttggtccttggtccccactgccttgccaaccagactccacaggtctctcccagtgtctcccagtgtacactgaatagggtagcagggcataccagaccctggctgcccccttgctctgtcaggacccaaggcccagcgtgcctgcacccttcccttgctcaccccca

SEQ ID NO: 14220 - DNA, 315 bp, Homo sapiens
gtttcctgctctcagtttacagaggcacttttatcttgctggggaagtgtgctgaaaagacacattcccagcccacacccagggatgctgattcagtcagcctgggtcagagggatagataaatatgtttaaagctccttgggtaattctgatgtgtaagtagcagttagctgcagtagagtccaattgcctcatttgattgaagtggaatcccagcatcaagtggacatgacttttggcccaagactgatgcttacaaactaagtggagtaggttatttgacctcactgaacatgcatcctttttttttttttt

SEQ ID NO: 14221 - DNA, 10166 bp, Homo sapiens; identical to SEQ ID NO: 14218

SEQ ID NO: 14222 - DNA, 249 bp, Homo sapiens; identical to SEQ ID NO: 14219

SEQ ID NO: 14223 - DNA, 315 bp, Homo sapiens; identical to SEQ ID NO: 14220

SEQ ID NO: 14224 - DNA, 10166 bp, Homo sapiens; identical to SEQ ID NO: 14218

SEQ ID NO: 14225 - DNA, 249 bp, Homo sapiens; identical to SEQ ID NO: 14219

SEQ ID NO: 14226 - DNA, 315 bp, Homo sapiens; identical to SEQ ID NO: 14220

SEQ ID NO: 14227 - DNA, 12904 bp, Homo sapiens
aaaaggcgacggcggattgacagaagtatgattggagagcccacaaactttgtgcatacagctcatgttggatcaggagacctgttcagtggaatgaattcagtaagtatgttggtgggacatgcaggtagggcattggggcatagtcatatgaaacctgtgtgacaggcacaagcatttttaatagcattatgctaaatgaatttgtgtacagtgaatgtaaatacataatatgagcatagaagagagaagcaaactactgatgaaaaattaatctctttgaatttcctggattaggtatttgtttctgtttcttgtacgcaactcttcatagctgcctttgtcccgaataaatactttgaaacttgaaaggatttgagttcagaatggaggttaatatcctattgattctcttgctcccaccaaagagacttggatatcagcctttttaataataatctctttttgttcttttaagttcagttagttgccttttgcacacatttttattgctttactttataaaccagtggtctccaacctttttggcaccagggaccagtttcgtggaagacagtttttccatgggggaaatggttttgggatgaaactgttctaccacagttcatcaggcattagattctcataaggagtccacaaccaaatccttgcatgtgcagttcgcaatagggtttgtgctcctatgagaatcccatgccatcactgatgtgacaggaggcagagctcaggcggtgatgctcacttgcagctgctcacctcctgttgtgcagcccggttcctaacaggccacttctggttttgggacccctgttataaactattcatctttacctggtaatattagaatgttggtgatttatttactctaagttctcatgcactaagcataggattagaattttcacatatccctttagggcaaggcagtaaaaatttgtcacatttgccagtaggatgtgaagaaccagaaataagatttattcgctgtcttttaatagaggtttcagtgagtttcagaataggctttagatctactcagctgaccttttagtccttaatttttgttgaagagaaaaccagaatgcattataatagaagcagcaccaaatgcgggttcttatcagagttgttcctcacatttgccttaaagcaggccactgagtttcaacagactgactcttttccccatgcctaaagtaaacaagtataaatgatccctaaagtgttcaaaaccagaaaggattttataaacataaaattatgatccactgtataccaacttactagacagcattaacaaaagacttaacagggactttaaaaataggtagatgggtatcctggatacagcaacgacgtttgtcactgcagttactaggtaagcaaaggaatgacatttgaaccttgccggaaaggaaacagcttgtttgttttaaatccgtaggaaaagtactttgtttcacttgactgctttgtggaaatgcaagaggtatcatgttgctgtcaaaacagtcagtagttttgtttcctgcatcaacatagagtgaaaagactaaatgaggccctattacttttattaatatggttactataataaagagaatgggtagtttcaaatttgttatatatgatgaattttaatttctctctcatcaacagatgttgtctctgccacctcagatttttaaaaaatccaactataaggccaggcacggtggctcacgcctgtaatcccagtactttgggaggctgaggcaggtggatcatctgagctcaggatttcaagaccagcctgagcaatgtagtgaaaccctgtctctaccaaaaatacaaaaaaattagctgagtgaagtaatgtgcacctgtggttccagctgtttgggaggctgagcggggaggactgcttgaacctgggaggggggaggttgcagtgagctgagatcatgcctctgaactccagcctgggtgacagagtgaaaccccatcttaaaaaaataaatccaaccgtataggaggaattaaattttagttcgtggcatttaaaatcttatgtacatttcggaatttcctttaagattcctccttgaatgaaaaacctgtcattggcttactatttttttgcttctcatagtttaggtagaactttaggactgtactttgcagggcttgcacacctgcctcttaatcttagatgcaggattgagatgggactttagctgtggtagagtttctaccttgctgtctccaggcagccttctctgctactgaagtggactttttatgaagtatttcagccctttagagctaaatgtgcttcccaaatgtgttctatagttatttcgtatttgagtttgctatctctaaagcaatattcagcatccatcccactgtcacagagcactgtgttcttgctgctaggaatggtgttgttcaattagtaacttttttttttgagacagagtctcgctctgtcacccaggctggagtgcagtggtgcaatctcagctcactgcaacgtctgcctcctaggttcaagcaatcctgtctcagcctcctgagtaactgggattacaggctcctgccaccatgcctggctaattttttgtatttttagtagagcggggtttcaccatgttggcgaggctggtctcaaactccggacctccggtgatccacccacctcggcctcccaaagtgttgggattacagccatgagccaccacgcctggctgagtaacttttcttgaaagtatcattgatagtactgatttgatgagcctgactctgtgagaaaaattatgttctcctatgcaatgcaataataaataagaagaaaccataaatagacatgctgtttattcaaataaaagaactgagcagctagtattaggaatgtggcttgacgcatatgaaacaggcttgcctaaactatattattgaatggttagatgacttgtaatttcttttttcttctaaatatattattcttctacctttacttagtgtaaaagactcttttctactaccctctttccagaaaagatttccgttacccgttcagtaatacaaccttgcgttaaaatattgtatattcacagtcacaataatacattgtctcaacactgaaagattacttattaaagttacttaataaaggttacttaagataaaccaaatcttttaaattgaagaattgacttttggagaaaaatactttttttttcttagaatctgcttggcattattgaatgcacaatgtaaaaacaaacaaagattttgtgtttggttggttttgggcttttttgatgcagagtctcattctgttgcccaggctggagtgcttactgcagccttgaccgcctaggctcaatcgatcatcctgcctcagcctcccccagtagctgggactacaggcctgcaccaccatgcccagctagtttttgtattttttttgtagagatggggtttcgctatgttttccaggctggtctcaaactcctgggctcaagttatctgcctacttcgaactcccatagtgttgggattacagctgtgagccactgtacctggtcataaagatgttttttaagccaggcctaaaatatctataaaagctaacatgccatgttaagtggaaaattacttggtatcaggtttgtgccacataacttaatgttagttaccataaaggggaagatgacgaatttgaactggtatcatatgacaggccctagcctcttcacactgcattaactgagcaagtttatgtttaaaaaacaaacaaacaaaaatatagatttcttcttacactcttacctgaaggtagtcattttattaatctgactattatagcaataccttataatgtgatgtcatacgaataagatgttccatgtaagtaaatttccaggttagtaaaaatgtccccatttaagagcaaaacacattttctcattaagactctcttgatctaaataagctatgcattttctgttttgccattatgttcttttacagtatatattgaaacctgacttactcaaaaaatgagttagacaagtcttactttaaatatattgactcagaatcaccagtggaaagcacctcacccttcatgccttatgttacagtaggtgctcagtaagtatttgataagcaggtgactgataaatagatgatgccccggttccttccaaattgtggaagtgtgcagggccctttgagctgattccatgaaataaatactcgaccacattgctagtgctctctctccactagttaggccatcacctccaaaatcatattgcttgtgttccttcttctagcagtctagcctgactctccaattctctgcttccagactgcttctaatttatatgaactaagactggaataataatgatatgctaaaagtacttcacagtttgcaaatgactttatgtgcctttgtttcagcaaaaagaaaatatcccaattttcatatatcttgcactctatcaggaaacagccctgcaatgtggtcgggagagattaccatcttaacccttttacagataagaagcctgatactcagagaggataaatagtttacccagttacaatattaataaataaactgggactatatctgtctttggattctttgattcttttttatcaggctatattaacatggtacattttttgacacagacttttaagatttatctttggttggtccaattttattcatgcttattttcttggttttgattctttactaagtaattgaggtgattatatatgtgagatatctgtaaattaagatacttgaggttgagaaacaaagtggagttgatcggccgggtgcggtggctcatgcctgtaatcgcagcactttgggaggccgaagcagtcggatcacttgaggtcaggagttcaagaccagcctggccaacatggtgaaacctaaaaatagaaaaattagctgagtgtggtgatgtgtgcctgtaatcccagctactagggaggctgaggcaggagaatcatttgaacctgggaggtggaggttgcagtgagctgagatgacgccagtgcactccagcctgggcaacagagcgagactgtcttaaaaaaaaagaaagtggagttgatctatatatttttgaccatttttcaaatgttaccaagtgccttgtgaattacaaaactgacttttgtaatttggaaatagagaaaataggggtttttgcaaaaaatgtttcagttgctagcctccctgtttgtccttataactagaaaattgtttgtctataaaaaaattttgtctataaaagtacccttctgaaaaaagcagcccaaataaaattctgggaaaagaattacttagttgcaccggacctacttcctgacttccattttgttttgttgtatttttgtcttgttttaggttagctccattcagaaccaaatgcagtccaagggaggttatggaggtggaatgcctgccaatgtccagatgcagctcgtggatacgaaggcgggatagccctggtcctttctccagtgagtactcagagctggggtctggacctgacggccagacatggccaggccaataatagtaaatatatgtatatatatataattttttaatggtgaacttattgggaaaggcaaaattactcagctaagtgtagtttctgcacttggaatgtaagttttaggttcttttccttattaagaactttaaatactttaaaacatctggttggggaggattctgatgacaagatgcttcttatgtgtcctttaaacaagagtgaaatcattattttgagtattgaggccgagcatggtggctcacacctgtaatcccagcactttgggaggcctaggtgggctgatcacctgaggccaggaattggagactagcctggccaacatggtgaaaccccatctctactaaaaatacaaaaattagctgggcatggtggcgcatgcctgtaatcgcagctactcaggaggctgaggcacgagaattgcttgaacctgggaggcaggggttgcagtcagctgagaatgcgccactgcgctccagcctgggtgacagagcaagaccctgtctcaaaaaagtactgatactaaagataatctcttgggtagtaattttacagttaagacttcattgtttataaacttttcaaattaattaaaaagactactttgaaaaaggataaaccctgaaaatgtagaaataatttcaagtttttttttgttttatagggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccagggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaattttgtttagtttttcttttctttcaaggaaggaattatttaccagaattcagttagagcaccttttttgcattcttatattttcagtcatgattcctatcatgcaaaaaacaacttaaaactttttgatttaaaagagaatttaaatttctatcattgtaatctttaacttcacagttcacctcttaatttaacaaatacctagtcagaatgaaaattaaatggatagaaataggactaataaaacatttatgcctggtgcagtgactcacaactgtaatcccagctcttttggagatggaggtgggtggatagtttgagaccagcctggacaacatggtgaaaccctttctgtaagtttttattgcctatcaaccacatgatttttaacagaggtatcagatatctacacagctttccatgatgaagcatcttgtccttatagtatatgtaggacttaattaaaatgaaattaaattaagaattctcctcatacttagccacatttcaggtgcttagcagtgtcatgtagtgatcagctgctgtattaggaagttatagactatttccaccatcacagtttggggagttagtttgtagtttgcctctaaaatggtttatgacactggttcccatagggagtgattttgctccccatggagacattagagcaatgtcaggagacagttttggtcatcacagcttgaggagggggtggtgcaggctctggggagtggaaagtagggatgctggtaaatatgctgtgatgtacaggacagcccccaccacaaagattgattgggtccaaaatgtccgtgccacagctaaaacctgttttaagacaaagaagatctctacgtctgcatactcaccaggtgtaacctgttagggactcttcgttgcattagatcatgtgcacaggtaagtgaggtgttctgctggtcgaatactgagaataggtgagttaggttttgttttatgagaattgccacaaacattctaaaaacagaaaagacaaatattaggaaagactatttcaaaacttctggtaacttttgtccttatcccatatccaaagattctaaaaagaaattggcttaaaatgaagttctttgcaaaataaaattctgacaatcccaactatgaaaaagtatctgaagaaactgatgttggtagaccaagagcaattacattgtgagcttatgtttttaaaggatatgcataaaatgttgaaggaggggcacataaccacaaaaagaaatatctataaaataatagagtatcagagtctagaaattgctaatatttatgaagacgcaaacatctacaaaattgataaagacgaaggaaattctgtgccctcggcttaaagtacactatacacaaacttaaaagaagtcattgaaactttaccttctacttgtctccatctagaatggtccagtaagaatgaaaccattaaattactcatcttcatctgactttttatgttgtagcaccttaacttttggttttcatagtgtttctcagactatgagggtttgcctttgataccttgtcccaggattccttgagccctggagttcaaggttacagtgagcttgacttacgatggtgcctctgcacttcagcctgggtgacagagcaagaccctgaatctttgaaaaaataaaagtgtttttcaatgagctgctccatctatgcaggaaggaaaaaaaaaactttattgtagatatatgcaacctctaggctcattttgacccctacctcatctttttaatgcccatcatcttaatgttgtatctggtttgcctttgatgcctagaagaagaaaaaaatctttgcatttactaaagaaaacagttactccctgagtaagatcaagtgtttgatctgggaccttataaggaagttctcaaagaatggtgatcttggtattgaagaaagctgattttcatctcattagaaggtaatctttgcagaaaagtaaagccggtgcttcattctaacccccagattttctattttgtaaatccaagctatggagttcattagagcttttacaactcactagaactcatgagttcagtagctttagacagttaaatgcagctgagaacctgccttgggggcccagaaagaattcctaggcttatgggaatgttttttgttttgtttttctcccttaaaggagcagcaagcaagtaacacacttctttcaaaatcttcagagcctcacctagttacctatttcttaaccattgctttaagttatataaacatattcatcctttttatgtctgtgtctttcaaataaatatgtaagctggcagagtcctttgccttagacaccacgccttcccccagagcctccgctgctgctgtgctctcccgcagggcttcatctgctgggcgctgcttccttagggagtatgtaaaacatttcagctgctgtttctgggtttctgcaaaaaactgtttttacttttcagaaatactgcaaaggaagtaaaaaccactctgcttctgtcttttggcaaaaccacccagattccaaatggggtaattttaagttcaatctctttccaatgtccataatgtccattgtgtcctattatcatttttcacaagtgtatgtaggttttgctcacctgattttctctggataggtacagcgtaagtgtacctaataagggactcgactgtccctctctaaatgcagccacatccaatctgtgcacaatggaattaaggccacagaccatctaagccaatagcatagaaggatctgttactcctaaaaccagaaacagaaacaagcagtcctttgtcccttcttccctcttttcaatctgatattcctataggaaactagtatgatcagatagacattttagaaaagtatcagctgggcatggtgacgcatgtctgtagtcccagctactttggagggtgaggcagatggatcacttgagcccaggacttgggtccatcctgggcaacatagcaagaccctatctcttttaaaaaaagaatctaagggttggacacagtggttcacgcctgtcatcccaacactttgggaggccgaggtgggcaaatcacaaggtcaggagttcgagaccagcctggccaacatggtgaaaccccatctctactaaaaatacaaaaattagccaggcttggtggtgcacatctgtaatcccaggtactcaggaggctgaggcaggagaatcgcttcaactcaggaggcggaggttgcagtgagccaagatcgtgccactacactccagcctgggcgacacagtgacactccgtctcaacaacaacaaaagaatctaggaaatattcattctactgtgaaggacacagtagagggtcaggcagtccaatctgtgattaacgggagttttacaaaaagcaaggaaaatgctcttcagaggaaaaagattttaaaaaaaagtctcttgaaatttcaaaaaatttgtttttacatttatactttctcacttcacagccctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgattacactagcaa

SEQ ID NO: 14228 - DNA, 789 bp, Homo sapiens
ctgcaatttcaggagaagtatactattgacagtaaactgggataagcagagccccatagtaggacactaacccaacgtggccagtggtctctcccaataacattatcatatctaagggatcatggaaaacaggacagatctaagataatcttcatatctggaaaactcttagataatcagtgaaacacagcagtacagtcaggaaatatctctaaggggtagatgagcatattggtcagaacagggacaccagctggtggctaaagttactggaaaatggggctcagcaccccatgagaagtgcttttcaaaaattaggaagagtcagccaggcgtagtggtgcgtgcctgtaatcccagctacttgggagctgaggtgcgaggattgcttgagcccagttaaaagaccagcctgggtaacatagcaagactccatctcaaaaaaaaaaaaaaaaaaaaaattaagaagagtgagtaagacccagcctagttagtcaacaggtttagttcccagctagaacagaccagagaagagtgaatggactaggaccaaatctgtcaccctctcaccctcccacctccaccccctccagctgaaatgacagattcattttagcatagaaaggtaattgggtataatctgaataataaccatcaaaatataatacatctgttaatgatgaaagccagaaagtaatgtttaaaatcagacagtgtattcaaaccactgtgttctttgccaacaataatagtgactgagggtaattttacatttgtctcgttttttaa

SEQ ID NO: 14229 - DNA, 1565 bp, Homo sapiens
gcaaagaccaagatttttgtcgtgtagtcaggctcatcatgcctgcctccttcttccctttggagaattctgagggaaattcctcaatctctcagaatcaaaatcttaagtgtctaaacttccaaatgactgcagcttttctcaagttaagaagccaaactaaaataggttaccatcctcttttttttttaggaaagagtttatgagtgtcacaagtgcctggtgtggagtttggattatttataggattattaaatgactctctgaggcacaggtgaatacataatttttttgagggagtttgcctaatgaacatttgtgcggtaaatattaagtaagcactgtttcatgtgccagggataaaagattaaagatagttcttccatctggggaggagatagcaaaacacatggacaattaaaatatggcctaattaaatactgtgataattataaatatcaggtgctcagaagtttgtaggaaggcctttgggggagaagagcaaagggtaggcaggtgctgttcaagttgttttagaaaagggaaccctgatgagtttaggatacagttggccctccatatctgtgagttttgcatttgtggattcaaccaaccgagattggaaaataagttaggcccatgatcgttgtgcctgtgctgaacaggtacagacatttttcttgctagtattccctaaacaatacagtatagcaactctttacatagcatttccactgtattaggtattaataaataatctagagtaatgatttaaagcatacaagggccaggtgtggtggctcgtgcctgtaatcccaaaacattgggggctgaagtggatcctcaaactcctggctgcttgagcccaggagtttgagaccagcctgggcaacatggtgaaaccctatctctacaaaaaagtacaaaaatcagcagggtgtggtggtgcatgccagctactcaggaggctgagatgagaggatcgcatgagcccaggaggttgaggctgcagtgagctgtgatcgtgccactgcacttcagcctgggcaacacagtgagaccctgtctgaaaaaaaaagaaaaagaaaataaagcctaccagaggatgtctgtaggttatatgcaaatactacaccattttatataagggactcaagtgtctatgggttttgatatccacaaaggctcttggaatgaacccagtggataccaaggaacaactatatatagaaatttaagtgtagaagggaaggtgtgtttcttgaaagggtaacagcatatgccaaggccacaggatacgtatggtatgtacatgcaagttgcctaggcagctggaacactgggacaagaatgaatggtaaagtagatgaagctggaggaattgtcaggatccagatcatgaggaattgtgttctccttattaaggaatttagatttggcttccagaaagatcgctttggcagtatatgtgaagagtggattttaccgtgggcatggtttgtcatgcctgtaatctcagcactttgagaggccgaggtgggcagatcacttgaggccaggagttc

SEQ ID NO: 14230 - DNA, 1564 bp, Homo sapiens
gcaaagaccaagatttttgtcgtgtagtcaggctcatcatgcctgcctccttcttccctttggagaattctgagggaaattcctcaatctctcagaatcaaatcttaagtgtctaaacttccaaatgactgcagcttttctcaagttaagaagccaaactaaaataggttaccatcctcttttttttttaggaaagagtttatgagtgtcacaagtgcctggtgtggagtttggattatttataggattattaaatgactctctgaggcacaggtgaatacataatttttttgagggagattgcctaatgaacatttgtgcggtaaatattaagtaagcactgtttcatgtgccagggataaaagattaaagatagttcttccatctggggaggagatagcaaaacacatggacaattaaaatatggcctaattaaatactgtgataattataaatatcaggtgctcagaagtttgtaggaaggcctttgggggagaagagcaaagggtaggcaggtgctgttcaagttgttttagaaaagggaaccctgatgagtttaggatacagttggccctccatatctgtgagttttgcatttgtggattcaaccaaccgagattggaaaataagttaggcccatgatcgttgtgcctgtgctgaacaggtacagacatttttcttgctagtattccctaaacaatacagtatagcaactctttacatagcatttccactgtattaggtattaataaataatctagagtaatgatttaaagcatacaagggccaggtgtggtggctcgtgcctgtaatcccaaaacattgggggctgaagtggatcctcaaactcctggctgcttgagcccaggagtttgagaccagcctgggcaacatggtgaaaccctatctctacaaaaaagtacaaaaatcagcagggtgtggtggtgcatgccagctactcaggaggctgagatgagaggatcgcatgagcccaggaggttgaggctgcagtgagctgtgatcgtgccactgcacttcagcctgggcaacacagtgagaccctgtctgaaaaaaaaagaaaaagaaaataaagcctaccagaggatgtctgtaggttatatgcaaatactacaccattttatataagggactcaagtgtctatgggttttgatatccacaaaggctcttggaatgaacccagtggataccaaggaacaactatatatagaaatttaagtgtagaagggaaggtgtgtttcttgaaagggtaacagcatatgccaaggccacaggatacgtatggtatgtacatgcaagttgcctaggcagctggaacactgggacaagaatgaatggtaaagtagatgaagctggaggaattgtcaggatccagatcatgaggaattgtgttctccttattaaggaatttagatttggcttccagaaagatcgctttggcagtatatgtgaagagtggattttaccgtgggcatggtttgtcatgcctgtaatctcagcactttgagaggccgaggtgggcagatcacttgaggccaggagttc

SEQ ID NO: 14231 - DNA, 373 bp, Homo sapiens
tgtttttaaagacaaggtcttgctgtgttgcccaggttggcctccagcccctgggctcaagcaattttcccaagtagctgggagtacaggtgtataccaccatgcccagctcattgtaagtattctttctggcagccaagaggactatgaagctaccttggttctttgcattttgcctttgtattggacttttaacctcctctcttggggctttccttgctagtcatctgattatctatcctttatatcctgacactaaaatctcttctgtttctgtgcattgcataggatgggaacagtatggtaacggtgtcactggcctttgaattttgcatttggacaagcctacttcaaatctggactccagttctga

SEQ ID NO: 14232 - DNA, 2738 bp, Homo sapiens
cagtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcggtaagccggggcgcccttgtcacacccactccagccctgggtcggtgtggggtcatcatctctgcccaggcaggtccagtgcggtccttcacgtggaagtggttttctgatcttttaaatgtttctcagtttacttttgttagtaggaaattattagatttcagagttgagaattctggcacggtggctcgcagccccgtctccactccagagctccccatccctgaggtgtcttccatttcctggcagggatcacatcacgtggctggctgcgtgctcccccgtctctctgtgcgccatgctaggtggcctccgtgagcctggtgtgcccgggacgctgccagccgtcgtgctggggcaggcagtgctgccgtggctttggggtcgcggcggggcgggtgtctcactgtgggtggtggttcgtggcaccgcgggagaggcccctcactgagccgcctgccttcccagcgtcacctgtctgggtttattttagtgggaggtgtgaggtggtgacctctccccacagatgtctgccctggtgcagctgcgtcctgtggcaggccctgtcctccccggatgccccccccagacaccctggccctcaccgtgccccgtgacacaggcacctccaccccaacacccgtcaggagcgccctgactcttctgactctccagtcgaaaccgcagcctgagctcccgttccacagaagcgccgtcaggcgtgtcctgagatggggtgacgtcgtggataagagagggtgacactgccacggccgtgtctttgtattcaaagaacacggtgtaacgtctcgtttgggttcaggagacttttggagctttggctttgtacgtacagagtagttgttgattggataaaaatcagatgacagtgaccgcagttggcccctgtgggagcagccgttgaagctttggcacatccagttgattcatgtgtcactgtagggcgcagtgtgctctacagccccacttctctgctcaaaaatctctttccgtgaggtggtgttggttctgtaggtccctccgtggctcctgttggtgggtgtggagggtggttctgtaggcccccgtggctgctccatggccccgttggtggacgtgggagggccgttctgtggagtcccccgtggctgctccatgtttgagtatctctgtggtcgtcggctccctggcctccagagtgtcctgtcccggggttcctgggtcgtagacagtagcgatgtgaggcttttgcttgttccatgggacactgggacaccttgtgagacgtttgtgggaaggaggggcttgggggcctgtgggaggctgcccaggcgtgactgccacggtgttcttctttccagggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcctgctggccgccgcgtcccccgagattgacccacaataaagcacaggccttaccgcggcgtcaccctctcccactcctttgttctgggtcctttcgggagggctgatgggcagcacaggaggcccgtcctcgggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagacctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggctgtgcaacgctggtcctttcttgggcgctggtgtgggggatc

SEQ ID NO: 14233 - DNA, 543 bp, Homo sapiens
tggaaccatgccagagccacattttattccaggatgcgacacggggcggcggatgcctggcctcggaaaccccctccctgcctatgagggcttgtccagggctcccctggaacacagctcagccaggcaaggctgggagaggctgggccccccaggtgacctgcagacgcctcccccacctacatgccccacgcaaggggagccctggagcccggcctgccttgacaggaaggagataggtgaaaaataaatacacggctgggccgcctgcagcaagcgcgacagtgcccgggacccccagggccactcctgcctctggtgcctcaccgcggcccaggccctcgtccccaagggttcagacaccactgtcggcgagcaccgtgctgggcgcagaggccacgtgtggtgggacggcagcctgctggcccctccaggtgaggaccaggagcacaggctgtggcaactccagcccgggcaggggccgggacctgtgtggataatccacccaaacaccccacggccctcatagccccgtgacacaca

SEQ ID NO: 14234 - DNA, 6584 bp, Homo sapiens
ttctcaacatctggcttagtattgtgtgcaaaatcagagaggggtgcaagatcctgatttctcagtaaagggaatagcggtgtgtgtggtgcgggtcgggacgaatgtgcgatttcggtgaggagggacctgtatcttaaatcgtctggtaaacatgttttcagactatattctcgctggttcccgtttcctggctttgctaattttaggctgtgatctgttttcaaggctgagccctacaaatcaatgcctcttccagagattgctgctcagaggatacttgttttacaaataaatgtttcctctcgctggttgtggaatttatatagaaactttgattcttccagggataaagttgggtgagcggacagaattagctctgggggagctggtgggaagaggaacattgggatgtgtaaggggcacagctccatatgtggccccacaaagactgcacccaggtcaggattggaggctctgcagtctgaggtcttgttacagggttaactgtctgctcggagctgcccgttagggaaactgtctcctcagggacagtcctgggtttactgggcattgagctcccctttagcgggtaggaggagggagatgccacctggtgtgactctctacagttcaggagaagctggatgctgatgggtgcttgttccttaggcagagagaggagaattcagccacctgaagtcagcacctacagaagcacagtctcctggctttgcctctgaattattaacagcagagcagcattaaagagcccacacactagaaggaggatatgaagaaacacccagagaatgtcacaaaaacccagaatgtcacagtattgttttcttcttgctggtgtcctatcctctctcctaacaccagccaccaaagctgatttttaaaaaatgccatgatttctcttgtttacaagaagctgtttcctataccctattcttgaaggataaagaaatagtcattcaaaagaaatatctggcttttcacagtgtttcatatttgttggcttcctatgaggtgactctgtctttaacaactaccattttctgcctgttttgttcaaagtctgctccaataagagttcttcaaatatctttctccattgcaaaatgtttgtaggtagcaatgaaataaaacatttaaaattaataccatgtttctataacactacatattaattaataaaggaatggattgtcattttcacagatcagatgtgggctggacataatgatcaatcaaaggcaagaagcagggagattatccatttatttatttaacaatgatcgataaccattctttgcccagtattgtgcttgtccccagggaataatgagaaatacaagacatatgtggtcttctcatcacaaagcttgtagtataagaggagacagtaaaaaaatcaagcaattaacttcctaaagtaatacatattctgtaagaagcctctggggtgcagtggatcataacagagggtgttgctggtagacagtggtgttggggaagactctctggagagccgaggcctgcgggttgagcaggaacaagctgggcactaggttggagggtgagtgctccaaagagaaggaatgataactgcaaaggccttgaaggtggaaggagcctagatttccagaacattgagggtagtgtggctcacacataggagagaggagagagctgatcacacaggcctatgggccattctgaggacttcagttattttgaaaccaatagtaagccactaggaaatttaaacaagaaaaaatatcaaattttagttttaaaagaacatctgattgtagagtagaaaagggattgaaggggagatgatcaattagaagcctgttaagttgtatacaattgacagtgggttgtattagcacaaagatggagagaaatgggtaatttcgagttttttggaagtggaatcaataggatttggtgatgggctgatgagagagagaggataaaagagttgtagatgaccccaaagttctgcaggagccacggggctagatgtatggtgccatctgctgagcggggagccaggaaggcagacaggatgtggaggtcagggcttaatttcggccaggttctgtttgagatgcccatgaaatagccaaatggagtgagatacaaaagtttggaacttttataagctgagggagatataaaagtttggaactctgaggagggtgtaggctacagacctcatataaacacatccaagccacgaatctctagatagaggggggaaggggccagaacccctgtgaggaagcactggaagcatttatgtttgtgtaaagaaaaaggaacaatctgaaaatgaaactgaaaatggagggttgaggagacttttgggaaatggagcaggagaaatcaatgtagcaagctcatggcaaaaagaaagttgttgttgactacaggcagtcagggattctagttgcttccatttccctaaaatgacatggttatgtttcttgatctacaggagttcaagcgacaatggcagcccaatacggcagtatgagcttcaaccccagcacaccaggggccagttatggtgagagggcattcagtgctccccagaccaggctgcagggaggttagcaggtgggggtgggggatttgggggggaataggggtggggttctcctgccttgccacccagtccccatttgagcaggagaaaaatatttccaacctcttttctcattttctcctcatttgacctgctctttcatctttcttgaccctctgcactttctgcccatggtgtggctaagcagctaagcagaagagagattaaatatcctctgattgacccagggctcggcacagtttcttacctcctgcttcctacaacatggacacaccagaacagctggttgtagcctatctgattgtttttctgcccctttcttcagcctggaggagaactgggaatgaggaatgtgggagtaattgtccctcaccctggtatctaatttcccagctcctggtggtctcactataaccaacaaattaaactggctggctcattcagtgtatcacatgaccctccattttcttccttacccatagaaattgactatatcagttgagattttgctggtttaataaactatcccaaagtttcatagcttaaaacatcagccatttagttggttcttaattctgtgggttcactgggctgttcttgggtctggaccagcttggctcatctcaggcactcactcatgcatctggggtaagctagtgcctggtatgcaactgaatggtcttggatagccttatggacatgtctggtagttagcaagctctcagacagcaagggtaatagagataactgggccttgttgttatcatcaagaaggctagtccaggcttccttttaaggcagttgcaggaggagcagaaagaaaaggcaagccacagtgcataagcacttttggagtctctgcttgcaccaggctttctactgtcctactgtccagagcaagtcataaggcccacccagattcaacagttgaagagacagatagcatcttgatgggaggaactgcaaatctacatcccagaggcatgcatccagggatgggaatagattgtggctacatttacaatctcctccatggattgtcaccatatgctctcaacactgactaactgttgcagtgttggagctggcctttggtgctttgtcattttgcctcccatgattctcctacttccttccctatggccaaaaaatgccctcaggatatccttaggacagagccttctgctgtgatgctaactaaaaatgtgaacgccagcccacgtttttccttagataatcttagccttcctgtatccagtgttctcagtcacatcactttcggaaatacgcttctttcatcccagaattctggttatcaaacgtgggaaggtgtattttaagaataatgataagttgcataacccacttccctggcttcttaatgggaagaagaaatgcttcattttgaatataaattgggaaaataaatctccactacagatatgctaaagtcaaatcttgggttactccctgcacgaccttatttagaaagaaacagctggccgggtgcagtggctcatgcccgtaatcccagcgctttgggaggccgaggcgggtggatcatctgaggtcagcagtttgagaccggcctgatcaacatggcgaaaccccgtctctactaaaaatacaaaaattatccgggcatggtggtgcatgcctgtaatctcagctacttgggaggctgaggcaggagaatcgcttgaacccaggaggcagaggttgtagtgagccgagatcatgccactgcacttcagcctgggcaacaagagtgaaactccgtctcaaaaagaaaaaataaaggtacaaacagctattattggcagctcatagttctcttctgaaaccattttatttcttcctctgggctacatagctacaaaaggtcagactgagaagctcaaaggaatcctaaaaagcaagattgaagataggagattaagggaaaggccagttgcccaagtactgaaaaatgagcatcaggcctacaggaatctctgagtgcagcagtaacatcaggagaagcccccacagccagtaacggaggagggcactgggggtgaggactctgcaggggaatctattagaggtagattctaacagcatggctttttttttttcttgatgtcccagggcctggaagcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctcatatt

SEQ ID NO: 14235 - DNA, 2735 bp, Homo sapiens
tttccttttttttaaattttattattattatactttaagttttagggtacatgtgcacaatgtgcaggtttgttacatatgtatgcatgtgccatgctggtgtgctgcacccattaacttgtcatttagcattaggtatatcgcctaatgctatccctcacccctccccccaccccacaacaagccccggtgtgtgatgttccccaccctgtgtccatgtgttctcattgttcaattcccacctatgagtgagaatatggggtgtttggttttttgtccttgcaatagtttgctgagaatgatggtttccagtttcatccatgtccctacaaaggacatgaactcatcatttttatggctgcatagtattccatggtgtatatgtgccacattttcttaatccagtctatcgttgttggacatttgggttggttccaagtctttgctattgtgaacagtgctgcaataaacatacgtgtgcatgtgtctttatagcagcatgatttataatcctttgggtatatacctagtaatgggctggctgggtcaaatagtatttctagttcaagatccctgaggaatcgccacattgacttccacgatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccactgatgatgagcattttttcacgtgttttttggctgcataaacgtcttcctttgagaattgtctgttcatatcctttgcccactttttgatgggtttgtttttttcttgtaaatttgtttgagttcattgtagattttggatattagccctttgtcagatgagtaggttgcaaagattttcccccattttgtaggttgcctgctcactctgatggtagtttcttttgctgtgcagaagttctttagtttaattagatcccatttgtaaattttgacttttgttgccattgcttttggtattttaaacatgaagtccttgaccatgactatgtcctgaatggtattgcctaagttttcttctagggtttttatggttttaggtctaacatgtaagtctttaatccatcttgaattaatttttgtatcaggtgtaaggaaaggatccagtttcagctttctatttatggctagccagtattcccagcaccatttattaaatagggaatcatttccccattgcttgtttttgtcaggtttgtcaaagatcagatggttgtagatatgcagcattatttctgagggctctgttctgttccatcgatctatatctctgttttggtaccactaccatgctgttttggttactgtagccttgtagtatagtttgaagtcaggtaacattatgcctccagctttgttcttttggctgaggattgacttggtgatgcagactcttttttggttccgtatgaagtttaaagtagttttttccaattctgtgaagaaagtcattggtagcttgatggggatggcattaaatctataaattaccttgggcagtatggccattttcacgatattgattcttcctacccatgagcatggaatgttcttccatatctttgtgtcatcttttatttcattgagcagtgatttgtagttctccttcaagaggtccttcacatcccttgtaagtcgtattcctaggtattttattctctttgaagcaattgtgaatgggagttcactcatgatttggctctctgtctgttattggtgtataagaatgcttgtgatttttgctcattgatttggtatcctgagactttgctgaagttgcctatcagcttaaggagattttgggctgagacgatggggttttccagatatacaatcatgtcatctgcaaacagggacaatttgacttcctcttttcctaactgaataccctttatttccgtctcctgcctgattgccctggccagaacttctaacactatgttgaataggagtggtgagagagggcatccctgccttgtgccagttttcaaagggaatgcttccagtttttgtccattcagtatgatattggctgtgggtttgtcatagatagctcttattactttgagatacgtcccatcaatatgtaatttattgagagtttttagcatgaaggttgttgaattttgtcaaaggccttttctgcatctattgagataatcatgtggtttttgtctttggttctgtttatatgctggattatgtttattgattttcgtatgttgaaccagccttgcatcccagggatgaagcccacttgatcacggtggataagctttttgatgtgctgctggattcggtttgccagtattttattgaggatttttgcttcaatgttcatcaaggatattggtctaaaattcccttttttttgttgtgtctctgccaggctttggtatcaggatgatgctggcctcaaaaaatgagttagggaggattccctctttttctattgattggaatagtttcagaaggaatggtaccagctcctccttgtacctatggtagaattcggctgtgaatccatctggtcctggaatttttttggttggtatgctattaattattgcctcaatttttcagagcctgttgttggtctattgagaaattcaacttcttcctggtttagtct

SEQ ID NO: 14236 - DNA, 2750 bp, Homo sapiens
tgaccttcaaaattgcttccacttctaattttgttttaagacactattgactacacttctcctaaaaattgatctttttgacgtgattgggctcttgagacttttttaccctttgtcctgatctgattctctccatgaatcaattttgttcatctcatctgtcactcttcctctgtatgctttgtaacctgcatttcctctacttctggcacttttttgccaatggaacctgcaattctactctgcaaatagctagggttgtttcctccctcactcccagccaaaatacagcttttatagtagtatctctgagtagggagttgggctattgagaaaaacatgctatagcccaaagtccctattttaaaagagatagagattggaatgatatgttctttttagggtgtggatgttttaggctccaatgaccataatcaaaatagatctataaccaagccgtaaaagggtaatatatgtgaattttctcataatatgaatcctaacacaaaagcagttacaatactttaagcgtaaattacatagtctgcaccatgattttttcaaaatttgtcttacgaacctcaaggaggaaaatgtaccccactggttaggaaagaattattttctctaggttccataacatagaaggagtgttttatttcctcactgccttgtgcctgggaatactgaaatgatagattcagccatgttttaataaaattcctctgtaagaatattagcatggagagagattggtataaatacatgaatgtgcctggattttgaaggtaaatcctatagctatcagattgctattcacttaattgccacaatctaaaatttatctgttagtgtttcttttctaattgttactagtgtgataaaaagaaaaactcttatttatatatagattatttgtttcaggacattaactgagaatatagtattgaaatgacttgaaattgaaggaatcagattttctactgcttatttattcagaatataacttacccaacaaggtctgatttaatttattttgaggagtagtatttagaagcaggattactcttatttaggaaaagaatctggatcttagatatacagtgacttgcccagagtcacctagtaaatgaaagaactataagtcaccacttgggcgtgtgattcatgatcttgactatgaattgataccagtactttacatgaaatggccatactctgaaaattatatttttagatataaccttaataaatatacttgcctttcacagaatattagaaccaattcctccttatcttcatggaggagcatacttaatgatatatgtactgatgagatttcgtcttatttttaaaaacttccaagaaagaatgtttcatagctcccttcattcatctactctggtgcttaattagatttgatacgagaacgctttctttcttatctaacttgaatccctcatgctgtagcttaagtctgttttctctcactctgcctaggatgccaaaagcagctaatcaccattatccatagtaatattcacaaagtcctccttatgtttgaaatgttagcgctataactgacagtaaacataacccccaagtatcagcaaattataaactagagaagagggactagcttgtagtaaatatagatgacatattagtatttagttgtgatgaatgaataacactaaataacgtgacttaagcattaagcagactaaatgaaaggcattcttctgttaactcattcacttaaatatttattaggcacctactttgtgatgctatgctacattcaagactttcaatgaaaatgatttttaaaaagtaaaacttattaagtatatttctcagaaatgtgaatgtacaatagcctaatattaacaagataaccctgtgccttatctaatcatcctgtggaatttacccatattttggaggtggggctgaaaaatagtctgattattagaacatttgtgtttatatttacagctgccctattactaaaatatgcagttggcatcaaaattttaccatacacagtcactgagcccttcacctggaagcctctttatttcagcattactgctgaagagttacctgtgtctttctgtgtgcatttgaacatgtgtgagcatgcagccagtgtagcactacaagatgcttatcgctagaaataaattatagagtcgtgcagcatgaaaattatatgcccgggaatgcagaacacagggttaccttctgcctcctttctttgtcatggacagcagaggcagaaaggagaaagagatttattctaaagccatttgaagctgaccaagcaatttataacagatgaaatgctgatttattgctgcagagaaaataatgggtgttcttgctaaaatgccattaatagctttattgtttaaagtgcaaattatattcagcaatttgttagtcctcttttgaggcaaagttgaagtaattcaatgtaggcttttagcagaaaaaaggacaaagtaattaacaaatcgtaaaagaattcattcaccaagattggctgatagttgaattctctgtctgaactataaagacatagggaaaatttgcacttaagaaatacaagatgactcaagtatttgtttaaaactgaaaagccataaggaagttggagttgggacactacagatttaggagtatgccttctgttggtgtccactgtgtctgcaagatgtggtagtcaaccagagaaaaactgaaaa

SEQ ID NO: 14237 - DNA, 1583 bp, Homo sapiens
ctgggcctcccgaagtaaaactattttaaagtgtacagttcagtggcaataagtatattcatgatgttgtgcaactgttaccactattggaattccagaacattttcatcaccccaaagagaaaccccacaaccatcaggaaccagtcctcattctcccctttcctcagcccctggcgatctctaacctactttttgtttgttttccaattctggacatttcctgtaaatgggatctaataatatgtggccttttgtgtctgcttctttcactaaggaaaaatgatttgcattttactcttgcatgttctgtgttgtttgtgtgggcgtattcatctaggagaaatcttcctgaagttccttctgtaactaattctgcactgtccatggagtcatgttattgtcagactggtggccttagagacatgctgttttctgcaacatcgtgacacaaaagggtgcaccctgtaagaatcatttgggaatttttgttctcttttcacaaacactacatctcaaatttttaatttgatcaaatttgactctcggtgtctgcaattttctttagaaattaagctaacaaacattatgacattgtaatattgtgaaccatgataaaatcttaaatagtgacaaatgaagcatgtgataacacaatattttctactttttacataatgcagagatggcaaaattacacatttaaaataagtagatatatttttccatccattaaatggttctaatttgcttactgcttctgcctgtatttacttccaaaccaggtatctgcgagcttttcctgcggctactttggaacagaagaagccatagtaacatagaggtgaaaaaggggtaaaaggtttcaggagcacctaggatttcaggcccagtgagaaatcacttcaaccaaattgcagcaggggagctggtctcaggttgggaggagagaggggagacttatttcatgatcttttctctatttcccatacagggaagagatagtattttattattttttatgtattattttgtatttacttatttatttattaaaatagagacgggggtctcaatattttgcttaagctgatctaaaactcccgagctcaagccaccctcctgccccagcctcctgaataggtgggattacagatgtgtaccaccactcctggcactgggaagatattttaatatgttttagaccaatttagaaaatgaagctaaaagaggtcatctaagggaaatcgtttcctaacattttgatcccgcatgcctatcagcagagaatgttttgagcatgtactcctaatgtgtgtacatttatttaaacattctatgatggaaaattcttaatttgtatactatttactgttctactttttaaaactttttaaaatcaattttattgaggtatgatttacatacaataaaatgtacccatttaaagtgtatggaggccgggcgccatggctcatgctgtaatcctagcactttgggaggccaaggcaggcggctcacttgaggtcaggaatttcaccagagatggtggaaccccatctctactaaaaaaacaaaaaaaaa

SEQ ID NO: 14238 - DNA, 1583 bp, Homo sapiens
ctgggcctcccgaagtaaaactattttaaagtgtacagttcagtggcaataagtatattcatgatgttgtgcaactgttaccactattggaattccagaacattttcatcaccccaaagagaaaccccacaaccatcaggaaccagtcctcattctcccctttcctcagcccctggcgatctctaacctactttttgtttgttttccaattctggacatttcctgtaaatgggatctaataatatgtggccttttgtgtctgcttctttcactaaggaaaaatgatttgcattttactcttgcatgttctgtgttgtttgtgtgggcgtattcatctaggagaaatcttcctgaagttccttctgtaactaattctgcactgtccatggagtcatgttattgtcagactggtggccttagagacatgctgttttctgcaacatcgtgacacaaaagggtgcaccctgtaagaatcatttgggaatttttgttctcttttcacaaacactacatctcaaatttttaatttgatcaaatttgactctcggtgtctgcaattttctttagaaattaagctaacaaacattatgacattgtaatattgtgaaccatgataaaatcttaaatagtgacaaatgaagcatgtgataacacaatattttctactttttacataatgcagagatggcaaaattacacatttaaaataagtagatatatttttccatccattaaatggttctaatttgcttactgcttctgcctgtatttacttccaaaccaggtatctgcgagcttttcctgcggctactttggaacagaagaagccatagtaacatagaggtgaaaaaggggtaaaaggtttcaggagcacctaggatttcaggcccagtgagaaatcacttcaaccaaattgcagcaggggagctggtctcaggttgggaggagagaggggagacttatttcatgatcttttctctatttcccatacagggaagagatagtattttattattttttatgtattattttgtatttacttatttatttattaaaatagagacgggggtctcaatattttgcttaggctgatctaaaactcccgagctcaagccaccctcctgccccagcctcctgaataggtgggattacagatgtgtaccaccactcctggcactgggaagatattttaatatgttttagaccaatttagaaaatgaagctaaaagaggtcatctaagggaaatcgtttcctaacattttgatcccgcatgcctatcagcagagaatgttttgagcatgtactcctaatgtgtgtacatttatttaaacattctatgatggaaaattcttaatttgtatactatttactgttctactttttaaaactttttaaaatcaattttattgaggtatgatttacatacaataaaatgtacccatttaaagtgtatggaggccgggcgccatggctcatgctgtaatcctagcactttgggaggccaaggcaggcggctcacttgaggtcaggaatttcaccagagatggtggaaccccatctctactaaaaaaacaaaaaaaaa

SEQ ID NO: 14239 - DNA, 147 bp, Homo sapiens
ggtcaggagatccagaccatcctggctaacacggtgaaaccccgtctctactaaaaatacaaaaaattagccgagcgtggtggcgggcacctgtaatcccagctactcgggaggctgaggcaggagaatggcgtgaacccagggggg

SEQ ID NO: 14240 - DNA, 184 bp, Homo sapiens
gctgcgatctcggcactttgggaggccaaggcaggcggctgggaggtggaggttgtagctagccgagatcacaccactgcactccagcctgggcaagattgagcactgagtgagcaagaccccgtctgccatcccggcacctcgggaggccgaggctggcggatcactcgcggttaggagctgg

SEQ ID NO: 14241 - DNA, 1321 bp, Homo sapiens
aattttgatttttttttttttttattgatcattcttgggtgtttctcacagagggggatttagcagggtcataggacaatagtggagggaaggtcagcagataaacaagtgaacaaatgtctctggttttcctaggcagaggaccctgcggccttccgcagtgtttgtgtccctgggtacttgagattagggagtggtgatgactcttaacgagtctgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctactttctacacagacacagtaacaatccgatttctctatcatttccccacctttcccccttttctattccacaaaaccgccatcgtcatcatggcccgttctcaatgagctgttgggtacacctcccagacggggtggtggccgggctgaggcgctcctcacatcccagacggggcggcagggcagaggcgctccccgcatctcagacgatgggcggcctggcagagacgctcctcacttcctagacgggatggcggccgggaagaggcgctcctcacttcccagactgggcagccgagcagaggggctgctcacatcccagacgatgggcggccaggcagagacgctcctcacttcccagacggggtggcggcagggcagaggctgcgatctcggcactttgggaggccaaggcaggcggctgggaggtggaggttgtagctagccgagatcacaccactgcactccagcctgggcaagattgagcactgagtgagcaagaccccgtctgccatcccggcacctcgggaggccgaggctggcggatcactcgcggttaggagctggagaccagcccggccaacacagcgaaaccccgtctccaccaaaaaaatacgaaaaccagtcaggcgtggcggcacgcgcctgcaatcgcaggcactcggcaggctgaggcaggagaatcaggcagggaggttgcagtgagccgagatggcagcagtacagtccagcctcggctccgcatcagagggagacggtggaaagagagggagagggagaccgtggaaagagagggagagggagaccgtggaaagagagggagagggagaccgtggaaagagagggagagggagaccgtggaaagagagggagagtggaattttgattcttaaagttttatgtgataatgccaaattgttttcc

SEQ ID NO: 14242 - DNA, 581 bp, Homo sapiens
attgcaccattgccctccaacctgggcgacagcgtgagactccatcttaaaaaaaaaggtaaataatgtgtatggtttaaagagttttgataaatggatgcccctgtgtaaccatcacaacactctagatacagaacattttcatcagccctaaaggttctcttgtgccccttctcagttaaccagggagtccccccactcctccagccctttcagcccaggcaatacttttctgggctgaaaagatttttttacattaagaaatataaggagttccggccgggcttggtggcttatgcctgtaatcccagcactttaggaggccgaggcgagcggatcacgaggtcaggagatccagaccatcctggctaacacggtgaaaccccgtctctactaaaaatacaaaaaattagccgagcgtggtggcgggcacctgtaatcccagctactcgggaggctgaggcaggagaatggcgtgaacccaggaggtggagcttgcaataagccgagatcgcgccactgcactccagcctgggcgacagagcgagactccatctcaaagaaaaaaaaaaaaaaaaaaa

SEQ ID NO: 14243 - DNA, 1511 bp, Homo sapiens
ggcaatattgaactgatgcctggctgtggattgaaatggcttcctggccaactcctcttggctgtttaaaatgtttgtgaccccacctagacttaccttcaatttatttacactacgctcctggttctacgtttgtgactgtttattgtctttactcctttcaccttctggaaggtaaatgatagctattattaatatattaaagaggactagatccaaaagtttgtagtatatgtgtggtggggggggctttccctcatagggaagaaaaagtattagctttttcccacctgtcactaggttcgtggctgagtcacctttaacagactacagattaagaagagaaaataacacaaatttatttaataaaagtttcacatgacatgaagttttcagaaatgaagacccaaagatacagggaaacctgtgtatttcagtgcttggatttgatgaagaatagacagtggtggggaaatgtgattggtcaaagcaggtaggatctaatggtaataaactggaggggagcttaacaaggcctgtttgtgcagattcttaatgttcctgtgttttcagagataaggacatttcctttcctcagggaatagcgagggcacctctggaatgagggtcttatgacttactttaggggaaggtcagaaaattgttttatggcctgtttcaggggagaagggtgggaggaggtcagaaaccttcctgcttctgctactttctcaaataccaaggtaccatattttggggtagcatttactgaaccctatcaccctcaatgttttcttcctttcactcttcactagcaacactcaagcatttttcccaactcatcattatgtctgaggcaggactttctcctcagaaagtggttcctgatgacctggttgataatccatgctttacatactcatcttcagcagtcatccactctgacattatctcccgtcactcactctggataggatttccaggtgtccattatttttatagacttttagcccttggcttccattttcagtcacctgtggaactcttcctcgtggatgtttagtaagtacttctaattaaatatgtctaaaatggaactcatccagttttccctccatcctcccaccaataagaaagcctgttgctattctgatgcaccgcctcccccggccccccactcctccccacagacacacacttaaatttttaatccttggccaggcacagtggctcacacctgtaatcccagcactttgggaggccgaggtgggcagatcacctgaggtcaggagttcaagaccagcttggccaacatggtgaaaacccgtctttactaaaaatacagaattagctgggggtggtggcacatgcctgtaatcccagctactcaggatgctgaggcaggagaatcacttgaacctgggaggcggagtttgcagtgagccgagatcgcaccactgtactccagcctgggtgacaagcgaaactccatctcaaaaaaaaaaaaaaaa

SEQ ID NO: 14244 - DNA, 33895 bp, Homo sapiens
aatctttcatttttacagattgaaagtagtgttccctgccaactgctagagtcagtgctacaagaactaaagggtttgcaggaatttctagacagaaactcccagtttgcaggaggaccattaggaaatccaaagtaagaataaatagggtttattaattcatctttttcttttcgttgtattttttgttgagatgatttacatactacaaagttggtccttttaaagtgtgcagtttagtattttttagtgtatctacaaggttatgcaaccatcaccactatctaattttagaacattttcatcacagcaataagaaactcttgtgcccatgaccagccattattattcatggaccttcccccagtccctggcaaccactaatctactttctgtctccacagatctgccttttctgactatttatataaatattatattttatatattacataagatacacaatatataaatatattatatgaatatatgtaaatggaatgtttatagaaatatagttatataaatggaatatttatagaaatatagttatataaatggaatatagaaatatttatatgaatggaatatttatagacatatttatatacatggaatctttatagaaatatttatataaatggaagtatgcaacagataacctttggtgtctgtttctttccccaagcatgttttcaaggtttgattgttgtagcatgtattactacttgtctcatttctcagtttatcagttgatagatatttgggttgtttcagctttttggctaataagaatgctgatatgagcattcctgtacaagtttttgtgtggacatgtgtttagacggactcttgctctgtcacccgtgctggagtacgaaggctccaacttggctcacagcaacctccgcctcccaggttcaagcaattctcctgcctcagcctcccaagtagcttagattacagatgtgcaccaccatgcccagctaattcttctttgtattttcagcggagacggggtttcaccatgttgaccaggctggtcttgaactcctgacctcatcatccactggcctcagcctcccaaagttctgggattacaggcgtgagccaccatgcccgaccaagagtggacatttgggttttttttttgagacggagtttcgctcttgtcgcccaggctggagtgcaatggtgcaatctcggctcactgcaacctccacctcctaggttcaagcgattctcctgcctcagcctcctgagtagctggggttacaggcgcctgccaccatgcccagctaatttttctatttgtagtagaaatggagtttcactatgttggccaggctggtctcaaactcctgaccaccttcaggtgatccaccatgcccagcaataatggattttttttttttttttgagacagagtctcgctctgttgcccagcctggagtgcagtggtgcggtctcagctcactgcaacctccgcctcccgggttcatgccattctcctgcctcagcctcccgagtagctgggactacaggcgcttgccaccacacccagctaattctttgtatttttagtagagactgggtttcaccgtgttagccaggatggtctcgatctcctgacctcgtgatccgcccgcctcggcctcccaaagtgctgagattccaggcgtgagccaccgcgcccagccaagaatggatatttttaagcctctaatataatacggactttttgttgaaaaataataatcacatggcattgggggagtcacatcactccttagaattgttaacgaggtattacagtataatctttttaaagcatatgtaggccaggcagagtggctcacacctataatcccaacactttggaaagccaaggcaggaggattgcttgaagccaggagttcgagaccagcctgggcaatataggagaccttgtcactacaaaaacacataaataggccgggcgtgatggctgatgcctgtaataccagtactttgggaggctgaggcaggcggatcacctgaggtcgggatttcaagaccagcctgaccaacatggaaaaacccgtctctactaaaaatacaaaactagccaggtgtggtggcacatgcctgtaatcccagctactagctaggctgaggcaggcgaatcacttaaacctgggaggcggaggttgcggtgagcccagatcgtgccattgcactccagcctgggcaacaagagtgaaactctgtctcaaaaaaaaatatcataaataaataataaagcatacataaatatacacttctttaaaagcaaaaacagagtctaagtaagtacacttttatataacattattcatactttgtgtgtgtgtgtgtatacatatatatatatattcccctgcccctgccgaggcagagtcttgctctgttgcccaggctggagtgcagtggtgcaatctcagctcactgcaacctctgcctcctgggctcaagcagttcttctgcctcagcctcccgagtagctgggattacatgcatgtgccaccaagcctggctaatttttgtatttttagtagagatggggtttcaccatgttgcccaggatggtctcgatctcttgacttcgtgctccgcccgcctcagcctcccaaagtgctgggattacaggggtgagccaccgcgcctggcctgtctttatcttttaagcaggagaatttacctccttcccattttattggaattagttaaatgtggtttattgttttggtttggtttttttggagacagagtcttgctttgtcgcccaggctgcaatgcagtggtgcaatctcagctcactgcaacctccaactccctggctcaagcgattctcctgcctcacccttccaagtagctgagactacagccccacaccaccatgcctggctaatttttctatttgtagcagagacagggttttgccatgttggcaaggctgatcttgaactcttgacctcagataatccaccttcttcagcctcccaaagttctgggattacaggagtgagccactgcatctggtctagttaaatgtttgatttttttctccccatcctgaatttgtgctttttgtttattttcttccctttcccatttccttattgtattggattgatcaggcctctctctaccttaaacaccaattaagaagttctacatatgatttttcttcctctgttagtcttaaattctgacagacatgcatctcagtcagcattaataatttaacaaactctattacattttgtttccttgccttctactgccatccctctccctccaaattatctggaattttacttgtcagatgtttttagtttgtttggttttttttctaacattatggtcttttgttaattgaattttaccattacatctgcaattatatgtaaattttctaatctacttctaatttctcttaattactcatttatctttacagtttttagcaggatgtttttttcattgatgtttcttgaattgtcacagaagcagttctgtcatctgcaaacagagatagtttcatcttttccatcttttcttgtctagctctacttgctttctcctctctgcacaaggtaatctctctctctctctttttctttttaattgagacagagtttcactcttattacctaggctggagtgcgatggcatgatcctcggctcaccgcaacctccgcctcccgggttcaagcgatgctcctgcctcagcctcctgagtagctgggattacaggcatgagccaccacgcccagctaattttgtatttttagtagagacggggtttctccttgttggtcaggctggtctcaatctcccaacctcaggttatccacccgcctcagcctcccaaagtgctgggattacaggcatgagccgctgcgccctgccacttatctctgtctgtcttttctctttttttttcttttttaggcaatcttgctctgtcattgaggctggagtgcagtgatgtgatcattattccctgcaatctcagactcagccgcctgagtagctggggctacaggcatgtgctgccacacctggctgattttttcttatttttctcagagatagggtctcactgtgttgcccaggctggtctaaaactcttggcctcaagttatgctccctccttagcttcccaaagtgctgggattacaggcatgacccactgcatccacccttacttgaggtgttttttggttttcttttttgagactggtctcactctgttgcccaggccggagtgcagtggcatgatcacggctcaccgcaactttgacctcccagcttcaagtgatcctcccacctcagcctcctgagtagttgggactacaggcacatgctaccatgctcagctaatttttttatttcacattttgtagagacaagttctcactgttttgcccacgttgatcttgcactcctgggcttaggtgatcctcctgtcttggcctcaaaaaatgctgggattttaggcatgagccatccgcactcagcccttattgaatatgtttaacatattcatatatttaacatattgaatatgcttaccatattcaataagtgagtttgtcaaatgtatttactgcattttacagagatgatcatatcattttcccccttacctttaacaatagagttaatacatgtcctaatttcgaccaacccttggattcctataacattagtttcattgactatggaaattttttaaacagatttttgagatctactttacataccactaaatttactcattttgaatgttcagttcagtgacttttagtaaattcatagaattgtgcaaccatcaccacagtccagttttagcacacttccattatctaggagacatacctcatgtccattagcagtcactttccattcccacttcttagccccagacacttactgatctgctctatctctgtagatgtgcctattcttgacatgtcatataaacagaatcatactgtgtggtctttgagtctggcttctttcacttagtgtgttttgggggctcatgtttgagatttatgtggtaggatgtattcatgctttgttcgtttttattgcccaatgaatgtggaattttaagatcatagaccatttctcagatcttcgtatacattttgcaccattttcttcccaaagtttaatgttgtagatgaaaaagtacattatctgtatgattctccttcctttgtaagtgacttagtgtttactttgaaatttttttgtgtttttttctttttgttaccgaaattcaaaagtcacatgatgtctttaggtatatcttctttacagctctcagtgagccttaagaatgaacgtcttggctttgatcagttttcttctctcgttttttatgtattgtgatacacattgaatatcccttatccgaactgtttggaaccagaagtgttttggctttcacgttttttttgatttttaaatatttgcattatacttaggttgagcaccccattccgaaaatttgaaatcgaaattgctccagtgcgcatttcctttgagcatcatgctgatgtgcaaaacgtttcagatttggggacatttcagatgttagtttttttttttattagggatactcaatctatgtttcttctgtcccattctctttggagaatcatattaactcttttgtatctagcttgtttcttctcttccgtaatttccttccttcctttctctcctttaccccctctttttacttgatctttttttttctacaggttaggaaaatttatagctgatgttctcagtcatttaattgatttaatctcagtcattttaagtagcatctgtttagtctgtgtcataaattttttctggccatcagcccttctggtgttggttgcccaaccttatgaattatttaaaaaaagtaaacatattaaatgtttgaattgtactgtatgtgttatatctcaataaagctgttataaacacacacattctgcaatttctgtttcagtactactgctaaagtgcagcagaggctgataggattcatgcgtcctgaaaacggaaatccccagcaaatgcaacaggaactgcagaggaagtttcatggtaaattattgcttctcatcagttaagcgtacatgacctcagtaaaattttattacttgaatagaaaacaatggactttcttagtaagatgtactttgtacacaaatatttgtaattaaaatatcagtgtaattgggtccggggtggtggctcacacctgtaataccagcactttggaaggctgagttgggaggatcacctcttcctgggaggcagaggttgcagtgagctgagatcatgccactgcactccagcctgggtgacagagtgagaacctgcctcaaaaaaaaaaaaaaaaaagtgtgattgggaaagtaggataatatggatattaatatggatattgtatatttccctatctcttttagcatatacatttttgttccttcctccaccagaaaacatgatacacacctatttcattatgttttttttattgtggtgaaatatatatataccataaaatttaccatttttactttttatttgtttatgtttctgagacagagtttcactcttgtttcccaggctggagtgcaatggcgtgatcttggctcactgcaacctctgcctcctgggttcaagaaattcttctgcctcagcctcccgagtagctgggattagaggcatgtgccaccacgcccggctaattttgtattttcagaagagacggggttctttatgttggtcaggctggtctcgaacttccaacctcaggtgatcccgtccgcctcggcctcccaaagtgctgggattacagatgtgagccaccgtgcccagccccatttttactttattttatttatttatttatttttttgagacagagtctcactctgtcgcccaggctggagtgcagtggcatgatctcggctcactgcaagctccacctcccgggttcactccattctcctgcctcagccttctgagtagctgggactacaggcgcccgccaccacacctggctaattttttttttttgtatttttagtagagacagggtttcaccgtgtttaagcaggatgatctcaatctcctgacctcatgatccgcccacctcagcctcccagagtgctgggattacaggcaagagccactgcgcctggcccgtttttactgtttttaagtgtacagttcagtggcattcagtatattcattttatgtacccattaccagcatctatctccagaacttttgtcatcttccccaaaaatgtcactctgggctgggcgcagtggctctcacctgtaatcccagcactttgggaggccatggcaggtggatcacctgaggtcaggagttcaagaccagcctggccaacatgttgaaaccccatctctaccaaaaatacaaaaattagccaggcgtggtggcgggcacctgtaatcccagctgctcgggaggccgaggcaagagaatcacttgaacccagcaggcggaggttgcagtgagccgaatttgtgccattgcaccctagcctgggcaacaagagcaagactctgtcttaaaaaaaataaacaccaaaagtcactctgtacccatgaaataataaccccccatttttttcccctatcctaggtccctggcaaccaccattctactttctgtctcttgaattttacaactctgggtaccctattaggatgaaatcaaattttacattttgtggcaggcttatgtcacttagcatactgtcctcgaggttcatccatgttgtaacgtgtcagaatttccttcctttttaagactgagtaatttctattgtgtatatgtgcatatgtgcacatataccacatttcctttatccattcatctgttgatggacactgagttacttccgttttttggctatcgtgaataatgctgctattaacatgggtgaacaaatacaaattaaagcctctgctttcagttcttttgggtatatacccagaagtggaattgctatatcatatggtaattctattactaatttttttgatgaactgccatactgtttcatagcagctactgcattttatgtttatgtttatctttatttctttttgagacggagtttcactcttgtctcccaggctggagtgcaatggtgcgatctcagctcactgcagcctccacctcccaggttcaagcaattctgcctcagcctcccgagtagctgtggttacaggcatgtgtcaccacacccagctaatttttttatttttagtatagttggggtttcaccatgttggccaggctggtcttgaactcctgacctcaggtgatccacccacttcggcctcccaaagtggtaggattacaggcgtgagccactgcgcctggccagccacagcattttatacttctagtagcaatgcacaagggttccaatttcttcacatctttgccaacatttgtctcattgggattttgatttgcatttccctaatgattagtaatatgcctttttatagagctaaaaatatgaatcaaatatttcattgtgctttttatcaattataagtagtaacaagtaaggaaagagcaaggcaactgaaaagttctcataatcttcagttattccagatacaagttagaacaataataagttattgcatgaactttttgtgccatttaattttttctaagttcttttgccttccattgttagggttagagttactttttctggccgtgatagaactttctggtttgtttgttttgagatggagtctcgctttttcgccgaggctggagtgcattggcacaatcttggcttactgcaacctctacctcccaggtccaagcgattctcctgcctcagcctctcaagtagctgggatcacaggcgtgtgccaccacacccatctagtttttgtgttttcagtagagatgaggttttgccactttggccaggccggtcttgaactcatgacctcaggtgatccgcccaactcggcctcccaaagtgctgggattacttgcgtgagccaccacgcctggccagtagaactttctcagttaacactcaaccatttacttttgtcccaagttactttcttccctactgaggaccctaggtttctattcatcattttgtaaattcttttttactatcttttaaattttttgtctctcttttatttttttggagatggagtcttgctctgtcgcccaggctccgcctcctgggttcacgccattctcctgcctcagcctcccaagtagctgggactacaggcacccgccatcccccccaccagctaattttttatgtttttagtagagaccgagttttaccgtgttagccaggacggtctcgatctcctgacctcatgatccacctgcctcggcctcccaaagtgctgggattacaggcgtgagccaccgcgcccagccacacagcaatattttcatggtttatgtgtacctacacaaacacagaagcatatatatatacacacacggagaagataataacataaatactactgattatcatggttgcctgtaatgggggctaggaagaaaacaacagggatttcaaccttaactacagtttttatttgaaataaagcaacttaacctatgttattttataataatttattttgttttctcattagaggctcaactaagtgaaaagatttcacttcaggcaattcagcagttggttcgaaaatcatatcaggctctggctttatggaaacttctttgtgaacatcaattcactatcattgtggcagaacttcagaaggtaattttttttatttttttatgattataccattaatactatgtttggattttttggatgagtattttggctttggaggggattattttgggaagcatttaagttatgatgaagttagtatgttatgggaagatggcacaaaaaaagcgtaccaacttgggggacctattttttcaaagccgcaagtttttacttgtgggtatgtgaatgaagtcatactttacaaaacatattttttaaaacagtggactttaccctttatttgagctacaggttcttctgagaatctgataaaagctatctctcactacccttaaagaaatgcatatcgacatggacacacagacttttgcttataatttcaaagggcccaacaacctaaattaaatactcttgactgggcaccatgcctcacgcctgtgatcccaacactttggtaggctgaggcaggaggatcacttgagcctaggaattcaagactatcctgggcaagatgtcaggacccatctctactaaaaataaaaaataaattagtcaagtgtggtggcacatgcctgtagtcccagctacttgggaggctgaagtgggaggagcacttgagcctgggaggttgaggcgccacttagccatgatggtgccactgcaccccagcctgggtgacagagtgagaccctgtctctctctgtctctctcacacacacacacacacacacacacacacatatacaccactcctacttcattttatgttttcttttttttttttttaagagatggagtctcactctgtcgcccaggctgcagttgtgcaatctcggctcgctgcaacctccacctcccgggttctagcaattctcctgcctcagcctcctgagtagctgggattacaggtgcatgccaccacgcccagctaattttttgtattttagtagagacggggtttcaccgtgttgcccagggtgatctcgaactcctgagctcaggtaatccacccgcctcagccacccaaaatgctaggattacagacgtgacccaccatgcccggcaactgctcctactttaaaggaagatatttatcactgtaggaaataaatggttcatatttcttttgatgttcacatttgaatcctttctaaggataaggataatcaacattaatctaaatgttagatagaatatatagaggaaatttattcctaccttttatttaattgtgagcatttctaaacgtatacaaaagtagagcaaaaactgtaactcccatatacatttgactcattcagcattttcaagatactgtgtttctaaaaaaaatagacagttccttgaacaacaacaatgtcatgatcagttaccagtttttcttgagacagtgtctcactctgtcacccaggctggagtgcagtggcatgatcacggctcactgcacccttgacctctctggactccagtgattctcctactttagcctcccgagtagctggtactataggcacgcaccactacgcctagctaatttttgtatttttttgtggagatggggtttcaccgtatctcctaggctggatagttaccaatattaactgtcaatatttgatagcaaaatctgtcttaaaaatgtctttttacagattggttcattcaaatcaggatctaaacagtttaaggggtttgctcatggaatttgtttttctctttcatctgtttcagtctaaagcagtctttccttctttttcttttccttgctgttgccttgtagaaatccagtcatccatccagtagaatgtccagcattctaaggacattctaaggcttttttttttttaatcctctttgtagcgagcttcttcctctatctcctgcattttctataaaatgaaagtttattatataggcttgattcagttcaggtccttttttgaggaagaatagaatacttcataggtagtggtttattcatcagactgttagaagatacaaaaggtttcgttgtccttcttttagttatactaagataaattgctggattcaagtagtaagcctaatactgccattgtggaattctccatcagattttaatcatccattgataatcattgctggaatttattatttcatttaggattacaaaagggtaatatttatttatttgtttgtttgttttttattttttttgagacagtgtctcattctgtcacccaggctggagtgctgtggagcaatctgagatcactgtaacctccacctcccgggtacaagcagttctcctgcctcagcttcccgagtagctgggactacaggcatgtgccacaacgcctggctgatttttgtagttttagtaagagaccgggtttcgccatgttggccaggctggtgttgaactcctgacgtcaggtgatctacctgccttggcctcccaaagtgctgggattacaggcatgagccaccatgcccggccaaaaggataatattttaaatctgtgattccttccccagttactagctgcaattctgtaaaaaaaaaaaaaaaaattctttttccttgtcctgtatggatatttcattactctgaaacacttactttttgactctcgtataccatttttcaacgttggaaggcagtctcctcattctttccactagtgtccaatgaatagtgtggcttttgttggtggttttgtttcttttaaatacatactgttttttatttttaaaaattcaagctaatatatttaattatgaaacttatctttttcataccaagtagaataataattttgagttttatagagtgataaatatattgtaggtaggtttttatcctgggtatgtttttgtgatccatcttcaaagctctcttccttacatcaccaatggcatgctcaatgaatgcaaattaaagatttgttcaagaattttaacacagtttgggtatttccttgaatttagaaaaaagagatagcagtcacatcactaacagaatcttttactatagtataaatcaatactttagagcttcatttggacaagcagatttgttcacaatacagattaaactccaatattattataaggcctagaataatggaattctaacagtgtttaggaaggagtaatatgtaagcccaagattttcaaatatagccaagtgattgttttttccattttataaccaaagccaggagatctgactctagttttggctctacttaagctttacttttctcatttggaaagtgagagttttggactagatctactgtaggttcttttccaactctctatgattttatgtaagttcgcaaaaatttgtttctactaattagtatattttcgcttttcaattatagagtctattaatatttaggttattttaatttattaaaataatttcattatgtttagaaatatggtatttctataattgtgatagaaaagttttatgctcctaggaacttcaagagcagctgaagatcaccacctttaaagatcttgtaatcagggacaaagaactcacaggggcattaattgcctctcttatcaactgctacatcagagataatgccgctgttgatggcattagtttacatttacaggatatctgcccacttctatatagcactgatgatgcaatttgttctaaggtatgatactttattacctatttcattgtttgttataagaggtatcatgtatgatgaaccatcttgtttcacttaatataggacctcagtcagttagatctcttaacctctcctagcctcagaatcctcatctaagaaaggggttggaatatgtggcttcttaaaaccagtgtatactcttttaagcttagcttttctttttaaaaatatttttatttatttatttgacacagggtttcactctgttgcttaggctgtagtgcagtgctgtgatcatagctcacagcagcttctaagtcctagactcaagcaggcctctcatgtagctaggggctacgggtgtgcaccactacacccagccaatttttttgttttttatagagacaagttctgatttgttgcacaggctggtcttgaactcttggcttcaagtgatcctcctgcctcagcctcccatagtgctgggattataagtgtgagccaccatgcccagccctcctttaagtttttcataaagaatattctctctttttttttaagactgagtacgatctcagctcactgcaacctccacctcccaggttcaagtgattctcctgcctcggcctcccaaatagctgggattacaggtgtgcaccatcacacctggctaattttttatatttttggtagagacaggatttcaccatgttgtctaggctggttttgaactcctgacctccgcctgcctcagccttgcaaagtgttgggattatagacatgagcctctgcgcctggcccataaagaatctttgatagtgtttctaggccatattaaaaaaccaaaggtgagaaattaagaaaaatcactaaatttagaaattaaggaaatttaggggataatttatctccttagcttaaggaaaagtactaaaacttcaagtaaatcttttagtgaattagagttaatgggggcatttttattgatcctttcctacaggtggaaaaaataaataaatcagtgtcacatggactgcctgctgcccaataatgtattgactaggcaagagaattaccagacaaaagttctcttgcttaacatatttgggagaggaattaagaatagctaggaatctttggtcaaaaacttttctgcctaaaattaagaagtaagtttgtagagttgttttcattttaatggtaataaccatatataaatttagacatagactaaaacttagttgacagcatcatctgtctgcttgattttatatatttttaagttcttgttatctcctcttctaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaaggtgagaaataaaatgtttcttgtatcttttactcaactcaaaagacaaacaatagtgtatgaatgaagcaagctaatgatgaaaagccactttccagatgcaaatcttctttcagcatcagaggccgagtgaaaggacgtaggaatgtggtatcattgtgttgcaatatttgatgactacactgacctgcagaagctgtaatgttctttctattttttgaaatgtacttttttttttttttttttttttttgagagtctcgctctgtcagccaggctggagtgcagtggcacgatctcagctcactgcatcctctgcctcccaggttccagcaattctcctgcctcagcctcccgggtagctggtattacaggcgcacgccaccacgcccagctaattttttatttttttatttttttattttttttattttgagacagagtcttgctctgtcacccaggctgaagtgcagtggtgcgatctcagctcactgcaagctctgcctcccaggttcacgccattctgcctcagcctcccaagtagctgggactacaggcgcctgccaccatgcccggctaatttttttgtatttttagtagagatgggtttcaccatgttagccaggatggtctcaatctcctgacctcatgatccacccacctcagcctcccaaagcgctgggattacaggtgtgagccaccgcgcccggccattgcccagctaatttttgtatttttagtagaggtggggttttaccatgttagccagggtggtctcgatctcctgacctcaggtgatccacccatctcagcctctcaaagtgctaggattacagacatgagccactgcgcccagccgaaatgtataactttttagcattagagtttcagttcttgtccagttcaattactgtatgttttacattgctttctggattacatttatttttcagatatttaaaattttttattgagttttaaggtataatctgcttactttttaaaaaattactttaaatcaaatctaacataatgtaaaggccataactatttgcacaggtattattttgaatcccaaggtatttttttccccccagtagggaactaaaactttcctttttgttatttgaaataggatctttttttccaatgaagaaatatatatatatatatatttttttttcctttttctttttttttttgtgagacagagtcttgttctgtcacccaggctggagtgcaatggtgcaatctcagctcactacaacctctgcctcgctagttcaagtgattctcctgcctcagccttttgagtagctgggattacaggcgcatgccaccaggcccagctaatttttgtatttttagtagaggtggggtttcaccatgttggtcaggctggtctcgaacccctgaccttgtgatctgccccctctcagcctcccaaagtgctgggattacaggcgtgagccaccacacctggcccccaatgaagaaatatatttaacagttgccttttaggcatattaagaccttttccttctgaagacctatcagaaatattttatgttagcagggtgactattgtacagtagagacataaccttgatcattattttcatgtgccagctaaggaaaaatgtatccaacttagtagtaagtcataggtcttcattcttttctttcccatcagtgagattttatgagggtgtggtggaactttctcttacggctgcagagaaaaaagatcctcaaggtcttgggcttcatttctataaacatggagaaccagaagaagacatagttggacttcaggccttccaagaaaggtgcattccattacgttagcagattgtcatctttatggatacagacttttctttgcataatgttttttgttttttgttttatgttttttttttttttttgagacagagtcttgctctgtcacctgggctggagtgcagtcgtgtgatcttggctcactgcaatctctgcctcccaggttcaagctattctcgtgcctcagcctcccatgtagctaggattacaggtgcacaccaccacgcctggctaatttttgtatttttagtagagacagggtttcaccattttggccaggctggtcttgaattcctaacctcaagtgatccacccacctcagtcttgcaaagtgctaggattatagccatcagccaccgtgtctggcctctttgtgtaaaggtcgaccacccaaagtgctgggattacaggcatgagccaccatgtccagtaggatttcattttaaaggataatttttaagtattcccaaatttgttgagactgttaaaaaggaaatgtgtgtccttaaaagaaatataggccaggcacagtggctcacgcctgtaatcccagcactttgggaggctgaggtgggcagatcatgaggtcaggagttcgagaccagcctggccatcatagtgaaaccctgtctctactaaaatacaaaaattagccaggcgtggtggtgcacacccgtaatcccagcaacttgggaggctgaggcaggagaattgctttaacccgggaggcagaggctgcagtgagctgagattgcaccacagaactccagcctgggcgtcagagcagggctccgtctcggaacaaagaagaaatatataacctttctataacatatatatatggagggtgttttgttttgtttttgtttttgtttttgagacaaagcttcactctgtctcctgggctggagtcagtggcaccatcatagctcactgtactcttgaccttttgggctcaagtgatccagtgatcctcctacctcagcctcctgagtagctgggactacaggcacatgtcaccacactcggctaattttttttttctctttaatttctgtagagacagggcctcactatattgcccaggctggtctttaactcctgggctcaagcaatcctttcttctcagcctcccaaagtgctgagattagaggtgtcagccaccacatctggcgaaaacatatttttttattactatatttaatgactttacccttttaatgtttaaccaaacacttctcaaacttattgaaaaagtatatggtttgtattattttaaatgccaaatatgtacatctattctgccaaatagtcttgaaatccttgtatatacttaggtaaggtaaatcaatggctttcttttttgttatttgttttgttttgtttttggggggttttgttttttgtttttgagacagggcctcattctgttgcctgagctggagtgcagtggcatgataatagctcacttgcagccttgaattcctaggctcaagcgatcctcctgcctctgcctcccaagtagctgggattacaggtgcacaccgccacgcctggttaattttttgtttcgttttgttttgttttttgttcgtttgttttttgagacagggtcttgctgtcacccaggatggagtgcagtggcatgatctcagctcacctcaacctctgcctcccaggttcaagcaattcttgtgcctcactcacctgaatagctggcactacaggcatgcaccaccaagcccggctaatttttgtatttttgtcagatacggggtttcaccaggttggccaggctggtctcaaattcgtgacctctggcagtccccctgccttcgtctcccagagtgctgggattacaggtgtgaggcactgtgcccagccaattttttgtattttttgtagagacgtggtcccgctctgttgccctggctagtcttgaactcccagcctcaagccgtcctcctaccttgacttccctatggctggcattacaggcgtgagtcaccacacttaccatcatttgctttctagttaaataatgtaattgttccttttccattttctttcagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcatgtaagggacatagtatattttcattctgagaatacactgtttagaagttctccatggtaatggtagcacagtcatcttggggaaaggtggtagttcttagaagttatcatgtaaggattcttgatttcttactggagtttatagggctaaagggttgtgatgcccagaaacagagcctttaactgctaatttttactattttctttattttagtttgaacaaatgcttaaattgtcacagcgatccaaggatgagctctttagtattgccctttataattggctaatacaagtcgaccttgcagataagctgctacaggtaaatcttttttcattgcagttgtgttaattattcttaaggagcataactcaatgatttaagcacatatatagatgtaaaaaattcagtttctcatcccatgcctgctattagatgttagtataaagctgagtaatgcagtatcttttcctaaggggcaaagtaggctactgctccaattttcttgttaattcgaagctgattgggatagtttgtattgcggggtagaaatcactggattatgaatatgagtcctgtaggtcatcttatcttaactctgctgttaagtcactgtgacttcagatatgtccttttacctaccctaagtttcagtgttcctcaatctgtttaatgaatacatagcatttgataatttcaataatgcctttgagctcaatgtctaggaatcaatagctgtgttatcaaagtttatttaaaaatttgtaattttatagtaaatttcctttttttttttttttttttttttgagatggagtctggctctgttgcccaggctggagtgcagtggcatgatctcagctcactgcaacctccgcctcccgggttccagcaatcctcctgcttcagcctcccaagtagctgggattacaggcacccgccaccacgcacagctaatttttatatctttttagtagagacggggttttaccatgttggccaggctggtctcaaactcctgagctcaggtgatctgcccacctcagcttcccgaagtgctgggattacaggcatgaaccactgtgcccggccaaatttccttttcttttttgaggcagggtctcaatctgtagcttaggctgaagtgcagtgcaatggcacgataatggctcactgtagccttgacctccctaggctcaggtgatcctcacacctaaccctcctgagtaactagaactataggcccgcaccaccacacccagctaatttttttgtagagacgaggttttgccatatattgcccaggctggtctcaaactcctgagctcacatgatctgcccacctcggcctcccaaagtgcgaggattacagacatgagtcgccatgcccagcctactaaattattgttatcaacctaatagaattgttttggaaactcttatgctaactgtggtaaaacaaaaattgtttataataagaaaatttgccctctcttttatctgttagtattggattataattttgcttgttttcataaaacaaggcaaagttgtagttgacttaaaaatactatattttccttatcaggaacattatctgtaggtggttagaaaatttttctgaataactatataatttctaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcataggtatggcataatattcttattgtgaagaatgattcaaaactgagctatatgtacttacattcagttttctttaattttagaagaatctaagttttaatatactgacctaaattttttaaataggatgttactttttagtcataaatgtatttctttatgtgttgtctaaaattgtggatctctcttatgagaaatctaaaatagatttttttttaaatctaatgattttttttcaagtttcagatggctttttatgtgtgtttggtatgaaacagtacatactaattgacgtatttgtatcatcaatccttaagaaattgtgtaactaaaaataagcgttttcccttctagcacagaaatttcacttcagcagcgactagagtacattgctcgagccattcttagtgccaaaagttccactgccatttcatcaatagctgccgatggtgaatttcttcatgaattagaagaaaaaatggaggtaagtgctaaagatcttaagctgtgtccacattgagtactagccacatagttattccacattccattcttcccttggtaagtaataggtctgagaagtcattattattctagttgcttttgtctgtttatatttatttttatgtttagatataaatcttaaagatttttaaggatgcacttgggtcataaaaacattgctataatttagaagttttctctttggcacttcgaaaggtttttcccagctgggtgcagtggctcacgcctgtaatcccagcactttgggaggccgaggcagccagatcatgaggtcagaagttcgagaccagcctggccaatatggcgaaaccttgtctctacttaaaaaaatacaaaattagccgggggtggtggcacacacctgtagtcccagctacttgggagactgaggcaggagaattgcttgaacccaggaagcggaggttgcagtgagctgagattgcaccactgcattccagcctgggagacagactgagactctgtctcaaaaaataataataataaaaaataaatgtttttcccaactgtttcaacagcaagtggattacatcacattcaccatttattttggaagcaaataagtagatgtatgaagtagagtaggctaaaattccctaactaagagaatcaagaacataccatcgtccaaatacaaaagtttgtttcttattcacaaaaatccaaggtgagtcttcctgattggcagctggctttcctccgtgtggttgatttaggaacccaagttctattttctggcactaccattccctagggcctctgctttatcttcagcagagggtggaaggaaaagaaagaacacattcactgtcttaaaaactatagccctgacatgacacactacttctactcacattcctttgaagagaacttggttgtatggccatacctcccctacagaggaggctgagctgtatagtctaaccatttggctacagtcttggaaggtataagtattgggcagcaaggagtctgccacagtatacttcctgtgaaatctattatgtttagttgatgtctgttatgataatattagcctattatgatagaaatcttcatttatacattattttagcaaacttaaagtcagatagtaggatccgttctttcaaacgtatgttgatttatcataaataaattaagacatcctgttttctgcccaaactaggttgctaggatccaacttcagatacaggagacactacaaaggcagtattcccatcattcttctgtacaggatgcagtttctcagctggattctgagctgatggacataactaaggtaataaaaaagcaagtgaaatttttatagtagttacctaataatgagaaatttttgttttttattttgctttttgtttcatgggggaaattaccttatctccacaaataagataaggcatctttggcagcttgtcactgggctgacagatcaccactgcttcatctgactcctagaaaaaggctaagctactctttccaggccagtagctacaaagaacctatcatcctcgcatgagagctgtgttaaaaccagcttatttccagcctgggcaacatggcaaaacctcatctttacaaaaaaatagcaaaaaaggccaggcactgtggctcacgcctgtaatcccaacactttgggaggctgaggcgggcagatcacctgaggtcaggagtttgagaccagcctggtcaacatggggaaactctgtctctactaaaaatacaaaaattagccaggcgtggtggcatgcgcctgtaatcccagctacctgggaggctgaggcaggagaattgcttgaacccaggaggtgggggtttcagtgagccgagatcatggcactgcagtctaggagcctgggcgacagagcaagactccatcaaaaaaaaaaaaaaaaaattagccaggtgtggtggtgtgtggttgtagttcatctactcaggagtctgaggtgggaggattgatttagcccaggaggcccaggttgtggtgagcctcgatggtgctactgcattccagcctgagtgacagagtgagaccctgtctcaaaaagaaaaaaaaaactaaaaaaccaaaaccatcttatttatggcctcgcttcttgccttggaaaaactaacttatctttgcttaactctctaaacctctttctctctctgtaattttctgagcagttccttcctcttcatttattcttagacatagttccaggtaccctgcaacactttgagatttgtcagtattcctgtgattcttcaacccattgtttatacaacactagttctaaaataccattgcaggaggtttgtagggaaggtggggatggttaatgggtacaaaaacaaaatgaataagacctatctgatagcacaatagggtgactatagtcaataataactgtatattttaaaatagagaatgtaattggattatttgtaactcaaaaggataactgcttgaggaatagacattctccatgacatgcttatttctcattgcatgactgtatcagaacatctcatgtaccccataaatacatacacctactgtgtacccacagaaatttgaaaaaatgaattttaaaattaataaatagaatgtcgttgcaacatcttcttcccagccaagaaaaaagctctacatgctaaaatgtgtttgaatgtatttaccatacccttaccctttttttttttttttggcggggggagacagagtctttctctgtcaccaggctagagtgcaatggcgtgatctcagctgactgcaacctccaccttcctcagcctcctgagtagctgggactacagccatgcaccaccatgcccagctaattttttttttttaaattttagtagagacggggtttcaccatattggccaggatggtctccatctcccgatctcgtgatccgcccaccttggcctcttaaagtgctgggattacaggcctgagtcaccgtacccggcccatacccttaactttttaaatatggagttataaccagctacatacatcatcacatctttatatcatatttcagaaactttatgtaaaatctttggttattttttaattttcaaggagtgcttcactattaatctctgaatgttgatctctagttggatgttaattttgggattttctctcacagctttatggggaatttgctgacccatttaaacttgcagagtgcaaacttgcaataattcattgtgccggttattcagaccctatattggtgcagacactttggcaagatatcatagagaaaggtaagtgttcagttataggtatgttagcatacgttatgtagtgacttggtggaggaatgcaagctgctagtaactaatataatgcaagctgctagtggctcatgaaaattgtgtatacctaagaagagagtaagtggaagtcacctgggtatggtggaggatgatcatacacagaatgacccaagtgaatattcgggagaatactcagtgaaaaggttatttaatttatattatttgtgctgccttataaaagatactgagacactcacctcagaatctaataaccagtataacctggtaagacatgagagtatctcagacaataacagaaacaccaaatctgttaatcatattaatgtgactatctgttctaaagtattttgaaccttgaaacagaattaaataaccaatgtaaacatttcacattaaaagtaatttgggtttcaaatgacatgtctttttgttacagaattgagtgacagtgtgacattgagctcctcggatagaatgcatgctcttagtctcaagattgttctccttggtaaaatttatgctggcacaccacgcttctttcctttaggtaagctgtgatcttaggtgcagtcacgtattttctgttctgatggttttctccgttgatatggacaaataacgatctttcgagtaaagtaaagagtttctttgctatttagttcagcactttaattctgcctctccggaaagacttccaaagaatggcagaatttgttaatgaagagttgagtatgaaactttctgtgactaactttccaagtttatattacctgtcttaggattgtgctgactgacaaactatgattatattgttggtaaccctatacaagtttctgaagagaaaagaaaaacggttgatgtttttgtgcataggtaatctgtgattgattcaactgttctttttttatgttgagggcatgtttttctttaaaatagcaaataattatgttaaaacttagtgtttgaatccctttcttaatgagatatggtggctataatttttaaataaggtagctaattatgagctatttgccaacctacaagtgttttcctcagtggtaaaacaatagaagcaacataaatacatccataaattagaatatcaactacttttgtgttatttaaaaatattgagagacatgaaaatcctcacaatataacttttttttttttttttgagacagaggctttctctgtcgcccaggctggagtggaatgatgccatctcggctcactgcaacttctgccttccaggttcaagcagttctcctgcctagcctcccaagtaggtgggattacaggtgcctgcaaccacgcctggctaattttctgtatttttattagaaatgaggtttccccatgttgtctaggctggtctcaaactcctggcctcaggtgatccgcttgccttggcctcccaaggtgctgggattaaaggcgttcgccactgtgcccagcctaatttttttttttttttttcaaatgagcattcaaacttgtttacagaccatctctgacttagggtctattccctctggacatagtcagaaataaaaccattttattcatacccttacttttgtaggtataatatggaaacggttccctttccataccattttattgatcctaaaaataaagagaaataaaagagcaaatacatactttatataaatgtttataagtgtgtgaaactggtacttttgatagttgttttaaaaaacactgcaccatggctgggcatggtggctcacaggtgtaatcccagcactttgggaggccgaggcggatggatcgcttgagcccaggagttcgagaccagcctgggcaacatggcaaaaccctgtctctacaaaaaaataggaaaattatccaggcatagtggcatgcgcctgtggttccagctactcgggaggctatggtgggaggatcacttgagcctgggaggtgaaaactgcagtgagctgagatcgaaccactgcactccaacctcagtgacacagtgagaccccatttcaataaataaataaataaataacactgtattgtacatagttctttttaaggaattttcattttaatttagaaataatcatgtgggctttgtgtggtggctcacacctgtaatctcaacactttggagaggcaaaggcaggaagattgcttgaagccaggagtttgagaccagcctgggcatagcaagccccgtctctacaaaaaaaattaagattagctaggcatggtagcacgtgcctatagtcctagctaatcaggctgagttaggaggatttctatgttttacttatatatatatatttttttcttttgatagagaagggatctcatggtgttgcccaagctagtcttgaattagccacgcctagctaatttttttgtatttttaatagagacagggtttcaccatgttggccaggctggtctcgaactcctgacctcaggtgatctgctcaccttggcctcccatagtgctgggattataagtgcgaaccaccacgcctggccataactataaatttggctgttactgtttatgataagataggcagttaaaagtaagaatgaggccacagttagaactgtcaaataaatctaggggtggggcattaaaaaacacatttaatatttctgaaatcaggatgcagttgcccttttctgaaaagctgttaaagtgaggaaacctatttatttatttatttatttatttatttatttatttatttttattgatcattcttgggtgtttctcgcagagggggatttggcagggtcacaggacaatagtggagggaaggtcagcagataaacaagtgaacaaaggtctctggttttcctaggcagaggaccctgcggctgccttccgcagcgtttgtgtccctgggtacttgagattagggagtggtgatgactcttaacgagcatgctgccgcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctatacagacacggcaaccatccgattcctcaatcttttccccacctttcccccctttctattccacaaaactgccattgtcatcatggcccgttctcaatgagctgttgggcacacctcccagatggggtggtggccgggcagaggggctcctcacttcccagtaggggcggccgggcagaggtgcccctcacctcccggacggggcggctggccgggcggggggctgacccccccacctccctcccggacagggcggctggccgggcggggggctgacccccccctcctccctcccggatggggcggctggccgggcagaggggctcctcacttcccagtaggggcggccgggcagaggcgcccctcacctcccggacggggcggctggccaggcggggggctgacccccccacctccctcccggacggggtggctgccgggcggaggggctcctcacttctcagacggggcagctgctgggcggaggggctcctcacttctcagacagggcggttgccaggcagagggtctcctcacttctcagacggggtggccgggcagagacgctcctcacatcccggatggggcgacagggcagaggcgctccccacatctcagatgatgggtggccgggcagagacgctcctcacttcctagatgggatggcggccgggaagaggcgctcctcacttcctagatgggatggcggctgggcagagatgctcctcactttccagactgggcagccaggcagaggggctcctcacatcccagacgatgggcggccaggcagagacgctcctcacttcccagacagggtggcggccgggcagaggctgcaatctcggcactttgggaggccaaggcaggctgctgggaggtggaggttgtagcgagccgagatcacgccactgcactccagcctgggcaccattgagcactgagtgaaggagactccgtctgcaatcccggcacctctggaggccgaggctggcggatcactcgcggttaggagctggagaccagcccggccaacacagcgaaaccccgtctccacccaaaaaatacaaaaaccagtcaggcgtggcggcgcgcacctgcaatcgcaggcactcggcaggctgaggcaggagaatcaggcagggaggttgcagtgagccgagatagcagtacagtccagcttcggctcggcatcagagggagaccttggaaagaggggagagggacagggagagggacagggacaggaaacctattttttttaaatactgttactaaaaaaaattatcagtgaagtcctcttcaatattgggatcgtgaatcgtctctgttttcttcttatatctttctgagttttctaggttctgtaattttaattttaggacattttcatcatcccagaaagaaactctgtgctcattagttgtcacttcccattccttcacaccctccagccctaggcagccactaatctactttagatttgcctgttctggtatatatcttacttttatttaaaaaaaactttttttttcttttaagctgagagtgatggtgcacacttgtagccccagcttacttgggaggttgaggtgggaggattgagctcaggatttcaaggctgtcgtgcactgtagttgctcctatgaatagccactatttctagtctgggcaacatagcaaaaaaaaccccccgccccaaaaaattgcaattggatttcagaagatatccccctagaaactattcagttatgaataagacctaccttttagtatcaagagctaaaaatccaaatttccgatctttttttttcttcccagattttattgtacagtttttagaacagcaggtttgtactttgaactgggatgtgggcttcgtaatacagacaatgaatgaaattggagtaccattacctagactactagaagtttatgatcagttgttcaaatcacgggtaaggaaaatattaaataacataaaattattttatttaattaaagtaactttgtagatatagagtggggtattttgattgcatttttgtatcctatcacttagtctaattacacttggttgagtcttggaaattatgcttttgactttttaaactgataatgagagttgctttcctgtatatcatgattaaaatgaaatattatttttgaatattaataaatatgctttactcttggtgaaagaggctaaaccaaggtgtgggctaaactcattacattaagaatcatcatttgctttaaaagaacaagattacattgtatttatttactataacctcatctaaaatatcagtgcttaaagatccttctcaccctgctgaaccttatcagactatatgttttgtaatttttatgctaaggataaaagatccaaataaaaacttgtcaaagtagattgtgtcttttatagcagcatcacacagtgctttacaacattagcctgtgatggaaatgagcaggtaactgtagtatctccatcttatattgcaaaaaacaagagcagagatgttaaataacctgcttaagtcacatggctagtaactggtgaagccagacctagaattaagtttctgttactgctagtttagtctctttatgatgtcagactaaatctgcataggttcaaagtaaaagtggtgtcacaacccatagaaagaaagatttttctcttatctcagattcctaagcgggacatttacatgctctgcaaagtagattggtatatcaaatatgcctcctaagtaatatcatagtgttgttaattaataagtttttaatgttgtttgaaatattaactataatcagatatataatttagtagccatgtgatattaaatgctttttaatagcgataagttttgcatggatcctgatgtctactttagtataaatgatttaaataatcaattgacacaatttgcctcacatttcattatgtatatttcttcataggatccattctggaacagaatgaagaagccactgcaccttttggattgtatacatgtattattgataagatatgttgagaatcccagccaagttttaaattgtgaaaggtacttatgaattaaatattggatcagcaaaagcttttaaatgcttctaataaatacctgggtaaaaaatttgaagagaagatgggaagattcttgtgtatattagcaataactatttgaatgatattgatcaccatgtatgaaaaataggagttttttccattttcaacccttgtcctaaatcctttctacagctgaacatacataatgtattcatttcttctactttagattagtgatctaggaccaaaacatttcaattatgtctttgtgatattattggccatttaagggatattcttttgaaaaagaatattagcaggaatcatctcttactgctttcttctcattgtaaaaatcttcaggccaggcgtggtggctcacacctgtaatcccagcactttgggaggctgagatgggcggatcatgaggtcaagagatcgagaccatcctggctaacacgtgaaaccccgtctctactaaaaatacaaaaaaattagctgggcgtggtggcgggcacctgtagtcccagctacacgggaggctgaggcaggagaatggcgtgaacccaggaggcagaggttgcagtgagccgagatggcgccactgcactccagcctgagtgacagagcgagactccgtctcaaaaaaaaaaaaaaaatcttcaaatggaacccacctacacccaagttttcttttttactttatttcttatttacttaatcacatggtctttcctcttctgtgagaattaaagttgccagaagttggtggggaagaagtcctgcaggaggaaatgtttgtaaatgtataattaatcatgtgtctttttcgttgtaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcgtccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggtgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaaccagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaa

SEQ ID NO: 14245 - DNA, 24477 bp, Homo sapiens
gaggctcaactaagtgaaaagatttcacttcaggcaattcagcagttggttcgaaaatcatatcaggctctggctttatggaaacttctttgtgaacatcaattcactatcattgtggcagaacttcagaaggtaattttttttatttttttatgattataccattaatactatgtttggattttttggatgagtattttggctttggaggggattattttgggaagcatttaagttatgatgaagttagtatgttatgggaagatggcacaaaaaaagcgtaccaacttgggggacctattttttcaaagccgcaagtttttacttgtgggtatgtgaatgaagtcatactttacaaaacatattttttaaaacagtggactttaccctttatttgagctacaggttcttctgagaatctgataaaagctatctctcactacccttaaagaaatgcatatcgacatggacacacagacttttgcttataatttcaaagggcccaacaacctaaattaaatactcttgactgggcaccatgcctcacgcctgtgatcccaacactttggtaggctgaggcaggaggatcacttgagcctaggaattcaagactatcctgggcaagatgtcaggacccatctctactaaaaataaaaaataaattagtcaagtgtggtggcacatgcctgtagtcccagctacttgggaggctgaagtgggaggagcacttgagcctgggaggttgaggcgccacttagccatgatggtgccactgcaccccagcctgggtgacagagtgagaccctgtctctctctgtctctctcacacacacacacacacacacacacacacacatatacaccactcctacttcattttatgttttcttttttttttttttaagagatggagtctcactctgtcgcccaggctgcagttgtgcaatctcggctcgctgcaacctccacctcccgggttctagcaattctcctgcctcagcctcctgagtagctgggattacaggtgcatgccaccacgcccagctaattttttgtattttagtagagacggggtttcaccgtgttgcccagggtgatctcgaactcctgagctcaggtaatccacccgcctcagccacccaaaatgctaggattacagacgtgacccaccatgcccggcaactgctcctactttaaaggaagatatttatcactgtaggaaataaatggttcatatttcttttgatgttcacatttgaatcctttctaaggataaggataatcaacattaatctaaatgttagatagaatatatagaggaaatttattcctaccttttatttaattgtgagcatttctaaacgtatacaaaagtagagcaaaaactgtaactcccatatacatttgactcattcagcattttcaagatactgtgtttctaaaaaaaatagacagttccttgaacaacaacaatgtcatgatcagttaccagtttttcttgagacagtgtctcgctctgtcacccaggctggagtgcagtggcatgatcacggctcactgcacccttgacctctctggactccagtgattctcctactttagcctcccgagtagctggtactataggcacgcaccactacgcctagctaatttttgtatttttttgtggagatggggtttcaccgtatctcctaggctggatagttaccaatattaactgtcaatatttgatagcaaaatctgtcttaaaaatgtctttttacagattggttcattcaaatcaggatctaaacagtttaaggggtttgctcatggaatttgtttttctctttcatctgtttcagtctaaagcagtctttccttctttttcttttccttgctgttgccttgtagaaatccagtcatccatccagtagaatgtccagcattctaaggacattctaaggcttttttttttttaatcctctttgtagcgagcttcttcctctatctcctgcattttctataaaatgaaagtttattatataggcttgattcagttcaggtccttttttgaggaagaatagaatacttcataggtagtggtttattcatcagactgttagaagatacaaaaggtttcgttgtccttcttttagttatactaagataaattgctggattcaagtagtaagcctaatactgccattgtggaattctccatcagattttaatcatccattgataatcattgctggaatttattatttcatttaggattacaaaagggtaatatttatttatttgtttgtttgttttttattttttttgagacagtgtctcattctgtcacccaggctggagtgctgtggagcaatctgagatcactgtaacctccacctcccgggtacaagcagttctcctgcctcagcttcccgagtagctgggactacaggcatgtgccacaacgcctggctgatttttgtagttttagtaagagaccgggtttcgccatgttggccaggctggtgttgaactcctgacgtcaggtgatctacctgccttggcctcccaaagtgctgggattacaggcatgagccaccatgcccggccaaaaggataatattttaaatctgtgattccttccccagttactagctgcaattctgtaaaaaaaaaaaaaaaaattctttttccttgtcctgtatggatatttcattactctgaaacacttactttttgactctcgtataccatttttcaacgttggaaggcagtctcctcattctttccactagtgtccaatgaatagtgtggcttttgttggtggttttgtttcttttaaatacatactgttttttatttttaaaaattcaagctaatatatttaattatgaaacttatctttttcataccaagtagaataataattttgagttttatagagtgataaatatattgtaggtaggtttttatcctgggtatgtttttgtgatccatcttcaaagctctcttccttacatcaccaatggcatgctcaatgaatgcaaattaaagatttgttcaagaattttaacacagtttgggtatttccttgaatttagaaaaaagagatagcagtcacatcactaacagaatcttttactatagtataaatcaatactttagagcttcatttggacaagcagatttgttcacaatacagattaaactccaatattattataaggcctagaataatggaattctaacagtgtttaggaaggagtaatatgtaagcccaagattttcaaatatagccaagtgattgttttttccattttataaccaaagccaggagatctgactctagttttggctctacttaagctttacttttctcatttggaaagtgagagttttggactagatctactgtaggttcttttccaactctctatgattttatgtaagttcgcaaaaatttgtttctactaattagtatattttcgcttttcaattatagagtctattaatatttaggttattttaatttattaaaataatttcattatgtttagaaatatggtatttctataattgtgatagaaaagttttatgctcctaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggtatgatactttattacctatttcattgtttgttataagaggtatcatgtatgatgaaccatcttgtttcacttaatataggacctcagtcagttagatctcttaacctctcctagcctcagaatcctcatctaagaaaggggttggaatatgtggcttcttaaaaccagtgtatactcttttaagcttagcttttctttttaaaaatatttttatttatttatttgacacagggtttcactctgttgcttaggctgtagtgcagtgctgtgatcatagctcacagcagcttctaagtcctagactcaagcaggcctctcatgtagctaggggctacgggtgtgcaccactacacccagccaatttttttgttttttatagagacaagttctgatttgttgcacaggctggtcttgaactcttggcttcaagtgatcctcctgcctcagcctcccatagtgctgggattataagtgtgagccaccatgcccagccctcctttaagtttttcataaagaatattctctctttttttttaagactgagtacgatctcagctcactgcaacctccacctcccaggttcaagtgattctcctgcctcggcctcccaaatagctgggattacaggtgtgcaccatcacacctggctaattttttatatttttggtagagacaggatttcaccatgttgtctaggctggttttgaactcctgacctccgcctgcctcagccttgcaaagtgttgggattatagacatgagcctctgcgcctggcccataaagaatctttgatagtgtttctaggccatattaaaaaaccaaaggtgagaaattaagaaaaatcactaaatttagaaattaaggaaatttaggggataatttatctccttagcttaaggaaaagtactaaaacttcaagtaaatcttttagtgaattagagttaatgggggcatttttattgatcctttcctacaggtggaaaaaataaataaatcagtgtcacatggactgcctgctgcccaataatgtattgactaggcaagagaattaccagacaaaagttctcttgcttaacatatttgggagaggaattaagaatagctaggaatctttggtcaaaaacttttctgcctaaaattaagaagtaagtttgtagagttgttttcattttaatggtaataaccatatataaatttagacatagactaaaacttagttgacagcatcatctgtctgcttgattttatatatttttaagttcttgttatctcctcttctaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaaggtgagaaataaaatgtttcttgtatcttttactcaactcaaaagacaaacaatagtgtatgaatgaagcaagctaatgatgaaaagccactttccagatgcaaatcttctttcagcatcagaggccgagtgaaaggacgtaggaatgtggtatcattgtgttgcaatatttgatgactacactgacctgcagaagctgtaatgttctttctattttttgaaatgtacttttttttttttttttttttttttttgagagtctcgctctgtcagccaggctggagtgcagtggcacgatctcagctcactgcatcctctgcctcccaggttccagcaattctcctgcctcagcctcccgggtagctggtattacaggcgcacgccaccacgcccagctaattttttatttttttatttttttattttttttattttgagacagagtcttgctctgtcacccaggctgaagtgcagtggtgcgatctcagctcactgcaagctctgcctcccaggttcacgccattctgcctcagcctcccaagtagctgggactacaggcgcctgccaccatgcccggctaatttttttgtatttttagtagagatgggtttcaccatgttagccaggatggtctcaatctcctgacctcatgatccacccacctcagcctcccaaagcgctgggattacaggtgtgagccaccgcgcccggccattgcccagctaatttttgtatttttagtagaggtggggttttaccatgttagccagggtggtctcgatctcctgacctcaggtgatccacccatctcagcctctcaaagtgctaggattacagacatgagccactgcgcccagccgaaatgtataactttttagcattagagtttcagttcttgtccagttcaattactgtatgttttacattgctttctggattacatttatttttcagatatttaaaattttttattgagttttaaggtataatctgcttactttttaaaaaattactttaaatcaaatctaacataatgtaaaggccataactatttgcacaggtattattttgaatcccaaggtatttttttccccccagtagggaactaaaactttcctttttgttatttgaaataggatcttttttttccaatgaagaaatatatatatatatatatttttttttttcctttttctttttttttttgtgagacagagtcttgttctgtcacccaggctggagtgcaatggtgcaatctcagctcactacaacctctgcctcgctagttcaagtgattctcctgcctcagccttttgagtagctgggattacaggcgcatgccaccaggcccagctaatttttgtatttttagtagaggtggggtttcaccatgttggtcaggctggtctcgaacccctgaccttgtgatctgccccctctcagcctcccaaagtgctgggattacaggcgtgagccaccacacctggcccccaatgaagaaatatatttaacagttgccttttaggcatattaagaccttttccttctgaagacctatcagaaatattttatgttagcagggtgactattgtacagtagagacataaccttgatcattattttcatgtgccagctaaggaaaaatgtatccaacttagtagtaagtcataggtcttcattcttttctttcccatcagtgagattttatgagggtgtggtggaactttctcttacggctgcagagaaaaaagatcctcaaggtcttgggcttcatttctataaacatggagaaccagaagaagacatagttggacttcaggccttccaagaaaggtgcattccattacgttagcagattgtcatctttatggatacagacttttctttgcataatgttttttgttttttgttttatgttttttttttttttttgagacagagtcttgctctgtcacctgggctggagtgcagtcgtgtgatcttggctcactgcaatctctgcctcccaggttcaagctattctcgtgcctcagcctcccatgtagctgggattacaggtgcacaccaccacgcctggctaatttttgtatttttagtagagacagggtttcaccattttggccaggctggtcttgaattcctaacctcaagtgatccacccacctcagtcttgcaaagtgctaggattatagccatcagccaccgtgtctggcctctttgtgtaaaggtcgaccacccaaagtgctgggattacaggcatgagccaccatgtccagtaggatttcattttaaaggataatttttaagtattcccaaatttgttgagactgtaaaaaagaaatgtgtgtccttaaaagaaatataggccaggcacagtggctcacgcctgtaatcccagcactttgggaggctgaggtgggcagatcatgaggtcaggagttcgagaccagcctgggccatcatagtgaaaccctgtctctactaaaatacaaaaattagccaggcgtggtggtgcacacccgtaatcccagcaacttgggaggctgaggcaggagaattgctttaacccgggaggcagaggctgcagtgaagctgagattgcaccacagaactccagcctgggcgtcagagcagggctccgtctcggaacaaagaagaaatatataacctttctataacatatatatatggagggtgttttgttttgtttttgtttttgtttttgagacaaagcttcactctgtctcctgggctggagtcagtggcaccatcatagctcactgtactcttgaccttttgggctcaagtgatccagtgatcctcctacctcagcctcctgagtagctgggactacaggcacatgtcaccacactcggctaattttttttttctctttaatttctgtagagacagggcctcactatattgcccaggctggtctttaactcctgggctcaagcaatcctttcttctcagcctcccaaagtgctgagattagaggtgtcagccaccacatctggcgaaaacatatttttttattactatatttaatgactttacccttttaatgtttaaccaaacacttctcaaacttattgaaaaagtatatggtttgtattattttaaatgccaaatatgtacatctattctgccaaatagtcttgaaatccttgtatatacttaggtaaggtaaatcaatggctttcttttttgttatttgttttgttttgtttttggggggttttgttttttgtttttgagacagggcctcattctgttgcctgagctggagtgcagtggcatgataatagctcacttgcagccttgaattcctaggctcaagcgatcctcctgcctctgcctcccaagtagctgggattacaggtgcacaccgccacgcctggttaattttttgtttcgttttgttttgttttttgttcgtttgttttttgagacagggtcttgctgtcacccaggatggagtgcagtggcatgatctcagctcacctcaacctctgcctcccaggttcaagcaattcttgtgcctcactcacctgaatagctggcactacaggcatgcaccaccaagcccggctaatttttgtatttttgtcagatacggggtttcaccaggttggccaggctggtctcaaattcgtgacctctggcagtccccctgccttcgtctcccagagtgctgggattacaggtgtgaggcactgtgcccagccaatttttttgtattttttgtagagacgtggtcccgctctgttgccctggctagtcttgaactcccagcctcaagccgtcctcctaccttgacttccctatggctggcattacaggcgtgagtcaccacacttaccatcatttgctttctagttaaataatgtaattgttccttttccattttctttcagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcatgtaagggacatagtatattttcattctgagaatacactgtttagaagttctccatggtaatggtagcacagtcatcttggggaaaggtggtagttcttagaagttatcatgtaaggattcttgatttcttactggagtttatagggctaaagggttgtgatgcccagaaacagagcctttaactgctaatttttactattttctttattttagtttgaacaaatgcttaaattgtcacagcgatccaaggatgagctctttagtattgccctttataattggctaatacaagtcgaccttgcagataagctgctacaggtaaatctttttttattgcagttgtgttaattattcttaaggagcataactcaatgatttaagcacatatatagatgtaaaaaattcagtttctcatcccatgcctgctattagatgttagtataaagctgagtaatgcagtatcttttcctaaggggcaaagtaggctactgctccaattttcttgttaattcgaagctgattgggatagtttgtattgcggggtagaaatcactggattatgaatatgagtcctgtaggtcatcttatcttaactctgctgttaagtcactgtgacttcagatatgtccttttacctaccctaagtttcagtgttcctcaatctgtttaatgaatacatagcatttgataatttcaataatgcctttgagctcaatgtctaggaatcaatagctgtgttatcaaagtttatttaaaaatttgtaattttatagtaaatttcctttttttttttttttttttttttttgagatggagtctggctctgttgcccaggctggagtgcagtggcatgatctcagctcactgcaacctccgcctcccgggttccagcaatcctcctgcttcagcctcccaagtagctgggattacaggcacccgccaccacgcacagctaatttttatatctttttagtagagacggggttttaccatgttggccaggctggtctcaaactcctgagctcaggtgatctgcccacctcagcttcccgaagtgctgggattacaggcatgaaccactgtgcccggccaaatttccttttcttttttgaggcagggtctcaatctgtagcttaggctgaagtgcagtgcaatggcacgataatggctcactgtagccttgacctccctaggctcaggtgatcctcacacctaaccctcctgagtaactagaactataggcccgcaccaccacacccagctaatttttttgtagagacgaggttttgccatatattgcccaggctggtctcaaactcctgagctcacatgatctgcccacctcggcctcccaaagtgcgaggattacagacatgagtcgccatgcccagcctactaaattattgttatcaacctaatagaattgttttggaaactcttatgctaactgtggtaaaacaaaaattgtttataataagaaaatttgccctctcttttatctgttagtattggattataattttgcttgttttcataaaacaaggcaaagttgtagttgacttaaaaatactatattttccttatcaggaacattatctgtaggtggttagaaaatttttctgaataactatataatttctaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcataggtatggcataatattcttattgtgaagaatgattcaaaactgagctatatgtacttacattcagttttctttaattttagaagaatctaagttttaatatactgacctaaattttttaaataggatgttactttttagtcataaatgtatttctttatgtgttgtctaaaattgtggatctctcttatgagaaatctaaaatagatttttttttaaatctaatgattttttttcaagtttcagatggctttttatgtgtgtttggtatgaaacagtacatactaattgacgtatttgtatcatcaatccttaagaaattgtgtaactaaaaataagcgttttcccttctagcacagaaatttcacttcagcagcgactagagtacattgctcgagccattcttagtgccaaaagttccactgccatttcatcaatagctgccgatggtgaatttcttcatgaattagaagaaaaaatggaggtaagtgctaaagatcttaagctgtgtccacattgagtactagccacatagttattccacattccattcttcccttggtaagtaataggtctgagaagtcattattattctagttgcttttgtctgtttatatttatttttatgtttagatataaatcttaaagatttttaaggatgcacttgggtcataaaaacattgctataatttagaagttttctctttggcacttcgaaaggtttttcccagctgggtgcagtggctcacgcctgtaatcccagcactttgggaggccgaggcagccagatcatgaggtcagaagttcgagaccagcctggccaatatggcgaaaccttgtctctacttaaaaaaatacaagaattagccgggggtggtggcacacacctgtagtcccagctacttgggagactgaggcaggagaattgcttgaacccaggaagcggaggttgcagtgagctgagattgcaccactgcattccagcctgggagacagactgagactctgtctcaaaaaataataataataaaaaataaatgtttttcccaactgtttcaacagcaagtggattacatcacattcaccatttattttggaagcaaataagtagatgtatgaagtagagtaggctaaaattccctaactaagagaatcaaaaacataccatcgtccaaatacaaaagtttgtttcttattcacaaaaatccaaggtgagtcttcctgattggcagctggctttcctccgtgtggttgatttaggaacccaagttctattttctggcactaccattccctagggcctctgctttatcttcagcagagggtggaaggaaaagaaagaacacattcactgtcttaaaaactatagccctgacatgacacactacttctactcacattcctttgaagagaacttggttgtatggccatacctcccctacagaggaggctgagctgtatagtctaaccatttggctacagtcttggaaggtataagtattgggcagcaaggagtctgccacagtatacttcctgtgaaatctattatgtttagttgatgtctgttatgataatattagcctattatgatagaaatcttcatttatacattattttagcaaacttaaagtcagatagtaggatccgttctttcaaacgtatgttgatttatcataaataaattaagacatcctgttttctgcccaaactaggttgctaggatccaacttcagatacaggagacactacaaaggcagtattcccatcattcttctgtacaggatgcagtttctcagctggattctgagctgatggacataactaaggtaataaaaaagcaagtgaaatttttatagtagttacctaataatgagaaatttttgttttttattttgctttttgtttcatggggaaaattaccttatctccacaaataagataaggcatctttggcagcttgtcactgggctgacagatcaccactgcttcatctgactcctagaaaaaggctaagctactctttccaggccagtagctacaaagaacctatcatcctcgcatgagagctgtgttaaaaccagcttatttccagcctgggcaacatggcaaaacctcatctttacaaaaaaatagcaaaaaaggccaggcactgtggctcacgcctgtaatccaacactttgggaggctgaggcgggcagatcacctgaggtcaggagtttgagaccagcctggtcaacatggggaaactctgtctctactaaaaatacaaaaattagccaggcgtggtggcatgcgcctgtaatcccagctacctgggaggctgaggcaggagaattgcttgaacccaggaggtgggggtttcagtgagccgagatcatggcactgcagtctaggagcctgggcgacagagcaagactccatcaaaaaaaaaaaaaaaaaattagccaggtgtggtggtgtgtggttgtagttcatctactcaggagtctgaggtgggaggattgatttagcccaggaggcccaggttgtggtgagcctcgatggtgctactgcattccagcctgagtgacagagtgagaccctgtctcaaaaagaaaaaaaaactaaaaaaccaaaaccatcttatttatggcctcgcttcttgccttggaaaaactaacttatctttgcttaactctctaaacctctttctctctctgtaattttctgagcagttccttcctcttcatttattcttagacatagttccaggtaccctgaaacactttgagatttgtcagtattcctgtgattcttcaacccattgtttatacaacactagttctaaaataccattgcaggaggtttgtagggaaggtggggatggttaatgggtacaaaaacaaaatgaataagacctatctgatagcacaatagggtgactatagtcaataataactgtatattttaaaatagagaatgtaattggattatttgtaactcaaaaggataactgcttgaggaatagacattctccatgacatgcttatttctcattgcatgactgtatcagaacatctcatgtaccccataaatacatacacctactgtgtacccacagaaatttgaaaaaatgaattttaaaattaataaatagaatgtcgttgcaacatcttcttcccagccaagaaaaaagctctacatgctaaaatgtgtttgaatgtatttaccatacccttaccctttttttttttttttggcggggggagacagagtctttctctgtcaccaggctagagtgcaatggcgtgatctcagctgactgcaacctccaccttcctcagcctcctgagtagctgggactacagccatgcaccaccatgcccagctaattttttttttttttaaattttagtagagacggggtttcaccatattggccaggatggtctccatctcccgatctcgtgatccgcccaccttggcctcttaaagtgctgggattacaggcctgagtcaccgtacccggcccatacccttaactttttaaatatggagttataaccagctacatacatcatcacatctttatatcatatttcagaaactttatgtaaaatctttggttattttttaattttcaaggagtgcttcactattaatctctgaatgttgatctctagttggatgttaattttgggattttctctcacagctttatggggaatttgctgacccatttaaacttgcagagtgcaaacttgcaataattcattgtgccggttattcagaccctatattggtgcagacactttggcaagatatcatagagaaaggtaagtgttcagttataggtatgttagcatacgttatgtagtgacttggtggaggaatgcaagctgctagtaactaatataatgcaagctgctagtggctcatgaaaattgtgtatacctaagaagagagtaagtggaagtcacctgggtatggtggaggatgatcatacacagaatgacccaagtgaatattcgggagaatactcagtgaaaaggttatttaatttatattatttgtgctgccttataaaagatactgagacactcacctcagaatctaataaccagtataacctggtaagacatgagagtatctcagacaataacagaaacaccaaatctgttaatcatattaatgtgactatctgttctaaagtattttgaaccttgaaacagaattaaataaccaatgtaaacatttcacattaaaagtaatttgggtttcaaatgacatgtctttttgttacagaattgagtgacagtgtgacattgagctcctcggatagaatgcatgctcttagtctcaagattgttctccttggcaaaatttatgctggcacaccacgcttctttcctttaggtaagctgtgatcttaggtgcagtcacgtattttctgttctgatggttttctccgttgatatggacaaataacgatctttcgagtaaaataaagagtttctttgctatttagttcagcactttaattctgcctctccggaaagacttccaaagaatggcagaatttgttaatgaagagttgagtatgaaactttctgtgactaactttccaagtttatattacctgtcttaggattgtgctgactgacaaactatgattatattgttggtaaccctatacaagtttctgaagagaaaagaaaaacggttgatgtttttgtgcataggtaatctgtgattgattcaactgttctttttttatgttgagggcatgtttttctttaaaatagcaaataattatgttaaaacttagtgtttgaatccctttcttaatgagatatggtggctataatttttaaataaggtagctaattatgagctatttgccaacctacaagtgttttcctcagtggtaaaacaatagaagcaacataaatacatccataaattagaatatcaactacttttgtgttatttaaaaatattgagagacatgaaaatcctcacaatataacttttttttttttttttgagacagaggctttctctgtcgcccaggctggagtggaatgatgccatctcggctcactgcaacttctgccttccaggttcaagcagttctcctgcctagcctcccaagtaggtgggattacaggtgcctgcaaccacgcctggctaattttctgtatttttattagaaatgaggtttccccatgttgtctaggctggtctcaaactcctggcctcaggtgatccgcttgccttggcctcccaaggtgctgggattaaaggcgttcgccactgtgcccagcctaattttttttttttttttttcaaatgagcattcaaacttgtttacagaccatctctgacttagggtctattccctctggacatagtcagaaataaaaccattttattcatacccttacttttgtaggtataatatggaaacggttccctttccataccattttattgatcctaaaaataaagagaaataaaagagcaaatacatactttatataaatgtttataagtgtgtgaaactggtacttttgatagttgttttaaaaaacactgcaccatggctgggcatggtggctcacaggtgtaatcccagcactttgggaggccgaggcggatggatcgcttgagcccaggagttcgagaccagcctgggcaacatggcaaaaccctgtctctacaaaaaaataggaaaattatccaggcatagtggcatgcgcctgtggttccagctactcgggaggctatggtgggaggatcacttgagcctgggaggtgaaaactgcagtgagctgagatcgaaccactgcactccaacctcagtgacacagtgagaccccatttcaataaataaataaataacactgtattgtacatagttctttttaaggaattttcattttaatttagaaataatcatgtgggctttgtgtggtggctcacacctgtaatctcaacactttggagaggcaaaggcaggaagattgcttgaagccaggagtttgagaccagcctgggcatagcaagccccgtctctacaaaaaaaattaagattagctaggcatggtagcacgtgcctatagtcctagctaatcaggctgagttaggaggatttctatgttttacttatatatatatatttttttcttttgatagagaagggatctcatggtgttgcccaagctagtcttgaattagccacacctagctaatttttttgtatttttaatagagacagggtttcaccatgttggccaggctggtctcgaactcctgacctcaggtgatctgctcaccttggcctcccatagtgctgggattataggtgcgaaccaccacgcctggccataactataaatttggctgttactgtttatgataagataggcagttaaaagtaagaatgaggccacagttagaactgtcaaataaatctaggggtggggcattaaaaaacacatttaatatttctgaaatcaggatgcagttgcccttttctgaaaagctgttaaagtgaggaaacctatttatttatttatttatttatttatttttattgatcattcttgggtgtttctcgcagagggggatttggcagggtcacaggacaatagtggagggaaggtcagcagataaacaagtgaacaaaggtctctggttttcctaggcagaggaccctgcggctgccttccgcagcgtttgtgtccctgggtacttgagattagggagtggtgatgactcttaacaagcatgctgccgcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctatacagacacggcaaccatccgatttctcaatcttttccccacctttcccccctttctattccacaaaactgccattgtcatcatggcccgttctcaatgagctgttgggcacacctcccagatggggtggtggccgggcagaggggctcctcacttcccagtaggggcggccgggcagaggtgcccctcacctcccggacggggcggctggccgggcggggggctgacccccccacctccctcccggacagggcggctggccgggcggggggctgacccccccctcctccctcccggatggggcggctggccgggcagaggggctcctcacttcccagtaggggcggccgggcagaggcgcccctcacctcccggacggggcggctggccaggcggggggctgaccccccaacctccctcccggacggggtggctgccgggcggaggggctcctcacttctcagacggggcggctgcctgggcggcaggggctcctcacttctcagacagggcggttgccaggcagagggtctcctcacttctcagagcggggtggccgggcagagacgctcctcacatcccggacggggcgacagggcagaggcgctccccacatctcagatgatgggtggccgggcagagacgctcctcacttcctagatgggatggcggccgggaagaggcgctcctcacttcctagatgggatggcggctgggcagagatgctcctcactttccagactgggcagccaggcagaggggctcctcacatcccagacgatgggcggccaggcagagacgctcctcacttcccagacagggtggcggccgggcagaggctgcaatctcggcactttgggaggccaaggcaggctgctgggaggtggatgttgtagggagccgagatcacgccactgcactccagcctgggcaccattgagcactgagtgaaggagactccgtctgcaatcccggcacctctggaggccgaggctggcggatcactcgcggttaggagctggagaccagcccggccaacacagcaaaaccccgtctccacccaaaaaatacgaaaaccagtcaggcgtggcggcgcgcacctgcaatcgcaggcactcggcaggctgaggcaggagaatcaggcagggaggttgcagtgagccgagatagcagtacagtccagcttcggctcggcatcagagggagaccttggaaagaggggagagggacagggagagggacagggacaggaaacctattttttttaaatactgttactaaaaaaaattatcagtgaagtcctcttcaatattgggatcgtgaatcgtctctgttttcttcttatatctttctgagttttctaggttctgtaattttaattttaggacattttcatcatcccaaaaagaaactctgtgctcattagttgtcacttcccattccttcacaccctccagccctaggcagccactaatctactttagatttgcctgttctggtatatatcttacttttatttaaaaaaaactttttttttcttttaagctgagagtgatggtgcacacttgtagccccagcttacttgggaggttgaggtgggaggattgagctcaggatttcaaggctgtcgtgcactgtagttgctcctatgaatagccactatttctagtctgggcaacatagcaaaaaaaaccccccgccccaaaaaattgcaattggatttcagaagatatccccctagaaactattcagttatgaataagacctaccttttagtatcaagagctaaaaatccaaatttccgatctttttttttcttcccagattttattgtacagtttttagaacagcaggtttgtactttgaactgggatgtgggcttcgtaatacagacaatgaatgaaattggagtaccattacctagactactagaagtttatgatcagttgttcaaatcacgggtaaggaaaatattaaataacataaaattattttctttaattaaagtaactttgtagatatagagtggggtattttgattgcatttttgtatcctatcacttagtctaattacacttggttgagtcttggaaattatgcttttgactttttaaactgataatgagagttgctttcctgtatatcatgattaaaatgaaatattatttttgaatattaataaatatgctttactcttggtgaaagaggctaaaccaaggtgtgggctaaactcattacattaagaatcatcatttgctttatttttttttttttttttttttttgagacggcgtctcgctctgttgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagaatcatcatttgctttaaaagaacaagattacattgtatttatttactataacctcatctaaaatatcagtgcttaaagatccttctcaccctgctgaaccttatcagactatatgttttgtaatttttatgctaaggataaaagatccaaataaaaacttgtcaaagtagattgtgtcttttatagcagcatcacacagtgctttacaacattagcctgtgatggaaatgagcaggtaactgtagtatctccatcttatattgcaaaaaacaagagcagagatgttaaataacctgcttaagtcacatggctagtaactggtgaagccagacctagaattaagtttctgttactgctagtttagtctctttatgatgtcagactaaatctgcataggttcaaagtaaaagtggtgtcacaacccatagaaagaaagatttttctcttatctcagattcctaagcgggacatttacatgctctgcaaagtagattggtatatcaaatatgcctcctaagtaatatcatagtgttgttaattaataagtttttaatgttgtttgaaatattaactataatcagatatataatttagtagccatgtgatattaaatgctttttaatagcgataagttttgcatggatcctgatgtctactttagtataaatgatttaaataatcaattgacacaatttgcctcacatttcattatgtatatttcttcataggatccattctggaacagaatgaagaagccactgcaccttttggattgtatacatgtattattgataagatatgttgagaatcccagccaagttttaaattgtgaaaggtacttatgaattaaatattggatcagcaaaagcttttaaatgcttctaataaatacctgggtaaaaaatttgaagagaagatgggaagattcttgtgtatattagcaataactatttgaatgatattgatcaccatgtatgaaaaataggagttttttccattttcaacccttgtcctaaatcctttctacagctgaacatacataatgtattcatttcttctactttagattagtgatctaggaccaaaacatttcaattatgtctttgtgatattattggccatttaagggatattcttttgaaaaagaatattagcaggaatcatctcttactgctttcttctcattgtaaaaatcttcaggccaggcgtggtggctcacacctgtaatcccagcactttgggaggctgagatgggcggatcatgaggtcaagagatcgagaccatcctggctaacacgtgaaaccccatctctactaaaaatacaaaaaaattagctgggcgtggtggcgggcacctgtagtcccagctacacgggaggctgaggcaggagaatggcgtgaacccaggaggcagaggttgcagtgagccgagatggcgccactgcactgcagcctgagtgacagagcgagactccgtctcaaaaaaaaaaaaaaaatcttcaaatggaacccacctacacccaagttttcttttttactttatttcttatttacttaatcacatggtctttcctctcctgtgagaattaaagttgccagaagttggtggggaagaagtcctgcaggaggaaatgtttgtaaatgtataattaatcatgtgtctttttcgttgtaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggcgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaaccagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaa

SEQ ID NO: 14246 - DNA, 5848 bp, Homo sapiens
tgtagatcaactgaggcatctacttgtgagtaatgtgggaggagatggagaagagattgaaagattctttaaattacatcaggtaattatatatacttttaaaaaatgtgatgctattttaaacaaacagtgggagtcatagtttatgtaaattgggactggaatactgtaataaatatatatatatattttgagatggagtttcactcttgttgcccaggcaggagtgcaatggcgcaatcttggctcactgcaacctctgcctctcaggttcaaatgattgttctgcctcagcctccccagtagctgggattacaggcatgtgccagcactcccaactaattttgtatttttagtagagacagagtttctccatgttggtcaggctggtctcgaactcccgacctcaggtgatccgcccacctcggcctcctaaagtgctgggattacaggccgtgagccaccaagcccagccataaatagataatcttaacaatattcctttctttgcctaagtcactgtatgtgaactgacatttgaaagcaggattaatatgagtcttgtagtgagctttcagatttttattctctgttgttgataaattcttttttttttttgagacagagtctcgctctgccgcccaggctagagtgcagtggcgtgatctcggctcactctaagctccacctcccaggttcattccattctcctgcctcagcctcccaagtagctgggactacaggacccccccaccacgcctggctaattttttgtatttttagtagagatggggtttcatcatgttagccaggatggtctcgatctcctgacctcatgatccacccgcctcggcctgccaaagtgctgggattacaggcgtgagccaccatgcctggcctgttgttgataaattcttattgaagtctgctagtaagagtttcttgttcaggttatatgataaatgccttttcattaaaagcacaagacatttagggacaagttgtttttggtttgtttgtttgtttgtttgtttgttttggcttaatgacctgaggaagaaacctgaggcaacagtgtagagatcttagtatttcagagccacaactggaattgatacggttaaaattgggagtagttcaaagttaagtatacagactctggattcaaagcacctgtgttaaaaatcccagctccaccactgaggtaaattacttgacttctctgggcttcagtttccttatacattataataggatgtggtatgaggattaatatatgctaaactcttaaaatagtacctgacacatggtaggtattcagtgttaccacttaattgttattttctagaaagcagaaagaccacaggaagaaaattggagacataagccggaaactaagtcagaatctaggttaaaaggaaaagagaacatcctgtaatcctagtgcttatgatgaacttaaaaccagtagtgtttacttgtctttttaacactaactgatttcattcagtcagcaagtatttattgaatgcctgctctgtgctagatacagactttaatactgcatctagcagtacacaaatcattttaaaatttgtatttaatataaggccaatattcctctttttacacaggaagaccaggcttgtgcaacttgccttattcttgcttgctccactgctgcctgtgatagagaagtatctgcctgggctactcgggctttctttaggtatgtgaaagtttttcttgtttatttatttgtttttttactgggccactttttaaaatgattttatcaatgtgataaagccttgccaaacagttgagtgactatgtaggcaaattaccaaaattcatttgcaaaagggtgaaatctggagagattataatggtaatagaagcaagtaaattagcatagtttatgcattattactttaactctggattctgttctgtaacttcttgtctactttctacactttgttctacctcagttactgtctcatctatcttttttacttccccaaacactatgccaattctgcttaatatgtatcattagtattgaaggcttctgaattactttaaggaaacttggtaccaaagagatatttctatttagaaaatatttaagaatttgaaatgtgattttgttagaaacgttttttgaagtactatctaaccataacctagtatgaaaattacaatgccatttactcacaaagtaaattctatgcattgcatatctttttcttagaagttatcagagtcccttataattcttcctggtagcagtttcaagtccacatttactgaataaatatttattataagtcttatgcatatactttactgtcagcacaatacattgaagtctctaatgtttaaagcatttacttggaagctaaacaggaaaaggaacaattccagtttttaagatggatggtttgttttactgaataaactcaacctcttgtcataaaaataggtatggtggtgaagcacagatgagatttccaaccactcttccgcctccaagtaatgttggtcccatcttggggtctcctgtctattctagtgagtatggaacattgaaatgaaattgtttctaatcgtttgaatcttagaacctttatagcaatttttatcaataagccttttcattatgttttatttactgctattgtataattgatgaatacatctatagattctgattcttaaaagtgatctattaatattgaatccttaatgtaaggaagcaaaataagatgtaaccaatcatatttacataactcatttggtatatattcagagggaaacagatgaatgatttaataattaactcgcacatcagtgttttccaaggtgggagttgttagaaacttactaggagatcagtccctaattcttgcatatatcgtggacaatgtaactccttatgcttagaaatagcttctgtggccaggcacaatggctcacacctgtaatcccaggactttgggaggccgaggcgggcagatcacctgaggttgggagtttgagactagcctgaccaatatggtgaaaccatgtctctactaaaagtacaaaaagtagccggcctgtggtggtgtgagcctgtaatcccagctactcaggaggctgagacgggagaatcgcttgaacccgggagacagaggttgcagtgagccgagatcatgccactgcactccagcctgggccacagaaagagaccctgcctcaaaaaaagaaaaaggaaataccttctttacctaattttgatcacattcaaaagattgagatgttcttttctaaatctttatattcttctttccctttttaggttctcctgttcctagtggtagtccctatccaaatccatcctttttgggaacaccgtctcatggtacctcttttctttgttttggattggattcattttgaagtgctaacattatgagttaaccttaatgcttagtgtgaaaaagatgaacttgccttattcccttgaaaataaatataattttagaagcgctgtccaagcaagttttggcatttggatgtgaatgcctttatttaggaggaactcctcttataataagcctggaaagcccattatttggctaccaggattaaattgaaccctaaaatctgtgtaatcagttctatttcactgtcagcattacaagcagtactggcaagtttgtttccttttcattctgcattgtgaacacttgcaagtctatctgggagtacccatccacatttaaatctctcttcttattaaggaaaaccaagttaaatatctatgtatttcattgtttttgtaaatacctttgtgtctagatacacaaacttgggttatgagaattctgaattttatgggttctaagattaagagatttatgggttctaagattaagattaagagatttatgggttctaagattaagattaagagatttgtttttcttatgtgtgtacaaggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatggggtaagtttgtcatgaaataatgaattattgctcaccttgtcccatcttgagtagttaaatatttttaactctgaatttgggacatcatttattcctattaaattttagttttagctcacttgttgatcaataaaacttttctattattccagtttttgttatctaactatattcattgctgtgttttatttctcttactctctcataatctatttttgtagcatcaaaatacagttgttccttaacacaggggttaggggatgccaaccaccattcctcaaccttcatgtagtcaaaaattcatgtacaacttttgactttcttaattactaatagcctactgtctagaagcctcactgataagtaatcaattaacacgttttgtatgttttttgtgttttctttttttaacttttgcatggtgtaggagtatgggggagtctcgtaaaaaccagaaaacctgctagacaaattctaaaacagccgtaacactgatattttgtgtcatatgtgttatacactatattcttaccataaagtaagctagagaaaaaaaattaagaaaatcataaggaagagaaaatatatttactattcattaagtggcaatggatcatcataaaagtcttcatccttgtcttcacgctgagtaggctgaggagtaggaagaggaagggttggttttgatgtgctggggtagcataggtgggaaaaaaatctgtgtataagtggacccacacaattcaagcccatattgttcaaaggtcaactgtatatctacttacatatgaatgtacagtgttacaaacttccccataactcagtgacatgtgtctacagttcaacagggcagttcttgtcttgctgggctaactcaagaataggcaatcagttgtgaagttaaagagagctatgcttatcttggctagactgtcacatgttcaaggttatattttccagctggtctagaatggcccaagatgaaacagcttggttgttctctacatggtttctcatcccccagcaggccagccaaagattatttagttggtggtggcagagttccttgagaaagagtagacacttgcaaaacctttattctaaactcagaactggcttaccatgcacttttccgccttattcacttggccagagggaagtcacagggccaactcagatttaaaaggtgggaaatagaccaccttttaggggagagacatcaaatcatactgcagaggggatagatatagggagggataaagaaatgtggttgtttttgcaatcagtctatcatgttatcttagttagctatcatgcctaatatatatttctcttagatttgagatgtatgatttcattcatctcatttgcttaaaagtatgaaacagtacagagcccctttataaatttcctgtttacaatttattatacagagccttttgatttttcttcagtaatatttcattatctgaaaaacttaggtacatcaggtatgaaaattttctagtattccactcttctagatagcttagtaaaatgttaaatgaaaccactgcaagttttaaaaactgaataaagccattaagttcctagagaaagaaatttattgtaattgtttttattcatttacagcacaatcattaaaacttttttttttccagaaacatttgggatgcaagcttagttgtggagagaatattcaagagtggc

SEQ ID NO: 14247 - DNA, 595 bp, Homo sapiens
aaaagatctcactctgttgcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactacgctatgagatactgactgatgtacatgtacatttagtgtttctttaggtatacctgacttattcattgaacacctatccactgatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaatatttt

SEQ ID NO: 14248 - DNA, 599 bp, Homo sapiens
aaaagatctcactctgttgcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactgtttatgctatgagatactgactgatgtacatgtacatttagtgtttctttaggtatacctgacttattcattgaacacctatccactgatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaatatttt

SEQ ID NO: 14249 - DNA, 5872 bp, Homo sapiens
atactggagtgtttcctccacactggaaagaggtgagtcatatcattgtgattggtgttttaagtatatttttattgttattttaaatggcattcaagtttagcttcaagttcaacagcagtcttagcctacttcctcccacacaaatactcctgccagtaaataggcactcttaaataaaacagtgcctgcaagaaccttctgacccattgaaattagtcttgccctgtcttcagaggtgtattcgtccctctctgggtgtagagcggtatttaagggtgacactcgggcacgcaggaggtgtggcagggggcggggaatgcaaggtcactgtggctcaggggcgggtgtgggtgcaggcgcgttgggaggaccctgggcgccctgggaagtccgagggcaggcggcagggctggcgggcagcagtgctggcttccgacgtgaggtggtgacggcgggccctgcgcccaggccctgtgctgccgaccgctgtcctggctgcgcagctccccagcaggcgccgggctcaggtcgcgccttcagttagcgctcagcctgcgctactgcgtctcctccgcttgcgatttctggtcggatcccagctggcccagacttgctctgaagtaggaggaaccgctgtcgagcgaaaagtgcacaccgggtgattgatgaactcttaatagaactaacctctcctgcccccaaccctagacacacacagagaaaacctccaccccagccccttctccagtcctcctcgcgggcgagaggggacgcggccgccagccggtagggtgattaactcaccgtctgtctttgcaaaagtgttccaggtggatcaggagcgccagcccaccccgcccgcagcctggccgctcgctgaggcgcggagagcgcggaacgagcgcgcgcatcacgtggcggcgcggacgtttgtgccgcgcgcccgccagaccgcccaggaggcggcggctattgttccccgcaggggcccggggcgccctgaaacggggtccacgtcagcccgctcccgagcgtgtcctcaggtctaaggacgggtggggcttcctttgtgtgttctctggaaggggctgggatggcgtcgttgctgccccaaggggtaaccgagggggattgagggaagatggtaccagctccctagagctcagctcaccagacctactcttccgctcgacccttgcagaggaggtggggacggatatggtatttgtagggcagcgctgtgaacaatggagccatcaaaaaggccttctcccagcctcctcaccaaccacggacattcctggcccaacaagacctcctggccaggttttgagccctgcttcccaggtaaaaacactgcctgtaccagagctctccatgaattttggtttaaattaggatttaaattcttctggcccttactaatgttaaaacccagcttttatgatttctccaggtagtattctttccttaaaataatccagactagctataggaaccaatcaggacattttgcccaagatctaggacagaaagactcatgcagtaactcctgccttacagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaaggtaggtgtgaaacctgagggaagtttttaggaataggctttaggccaggtacttaaatccatttgttcccaaccttggactccaaagataagggcatttgtagctggagtagaaaagaagggaacaatgagaactaagatttcatcctctgtgatgattcttatcattcaccgtccttcctctccagcatcaccagtgcagaaagtgcagaggacttatgtacccaatctttttttttttttttttttttttttgagatagagtttcactcttgatgcccaggctggagtgcaatggtgtgatctcagctcactgcaaccttgcctcccaggtacaaacgattctcctgtctcagcctcccaatatacccaatctttctcctttctatccaggccttctgcaagagagatctaagaaccagccctcaaagatggtaagggcttggctagtgacagcccagtctcagctccctgtgcccaaagtgtcggaacagggccactcaacccaagccctacatatatactctgggaagttgcagtgcctcgaagtgatcaggccatagtcctgtgaagactggggtcatccatgtcccttcctgcctactcacaaacttctgttcttcctattcttttctttcagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaggcagttgggcccttcagagggcgtttggttgtgtttagactcggttgctttctaacactaattgcaggctcaaaaggagcggaatttattgcgaaggccaaggcggcttgtttataatttatgaagttttaaatggctgtgccgcgggccccaactttctcctgggctggcagccgcgcggaaacgcgccctcccccggctcgccgcccacccccacccacgcccctcagatgagtctcacgccaatggcaggaacagatccgagctattagaagtctcgggaacctccagagatgacagaaggtggcagatttggtccaagccctcaccccactcgagaggagggcgtcggggaaagctgtggctgcctggagagggagcccctgatcccacacttccttggagcctgagtgtgagaggaagctaatgtcagccgggctagacaccgtttaaagtctaatccatgaaaccctaagccgcaaatgacacttggggctttgcagacacccgcagactcagcagatactcctgcggtaacacactgtgctggaaaacgcctggagccatgacacattacgtatttttattattatttatggtaggaagaggagatgagggaaaatcgggctgaatctaagcagcctgacaattcagctagttaatatttagccagttaagaaaggtggttgtaatccctgcaaggcagtgagctctcctttgatttctctaatagcttaaaaaataatttcttacaagacaattagaaattctgcctatggatgcaaatttcatagaaaacaatgttaagccttgaaagtgggtaaaatgtgccttcgattgaagtcatttattctgttgatacacttctacaacatatatattttaaacctgctcagataaagtgaaatttagcaaaaggatatcccctcccacccccaaatctaacatgccattttaaaaacagcacaaaggaacaaggaaactaaatattattttgagccatcattacttagtgaaatacaaacatccaaatagaaacgattgttgttccaccagaagattagaagttaaattatttccacacaataggaatttcacttcgtgtcatcggggatgtagtaggagttgcattatttgtcaaaccaaatagagatgcgtgggctgactttgctgaaatacaaaagaattgaaccttatctgaaggcgttttctaagtggcccctcccatagaagccgggaagttgtccacccctagcagaagccacattaatatttacaaaatggttataaatccttgaagacatttttgcccattttgtataagaaacaggagtaaacaaggtgtttatacttgttatgtttcattaatgaaatattattactttacatcttggggaatgtttgttttctttagaaatgaactaatgatcactacaaaggaagaattcatgacagcatttcctagagaaaaagcttaggtacgcgtctccaaatgatggtttctttttctacaccttagctttttcatagctcaattcttcttacaacttctcttgtgttttttctttgattgtcagttttctttcaaagtttattttttgttacttaatgcagaaaagtgagctctggtctccccagtgtaaaagtcgattgtgtctagaaagaaggcagtaaaaacagcaaagcaggcgctgctttcaaaaagccctgcccaaatcatcccgcccagaaccttcttaggtttgcatcctcatttccccctcccctaatttcaatagctggaaagtaatcaagtatcccgagaaccaatttatgcactagactccaaataaataaaatatttttttcaaagtgtca

SEQ ID NO: 14250 - DNA, 4754 bp, Homo sapiens
  misc_feature (99)..(99): n equals a,t,g, or c
ggtaaccgagggggattgagggaagatggtaccagctccctagagctcagctcaccagacctactcttccgctaagacccttgcagaggaggtgggganggatatggtatttgtagggcagcgctgtgaacaatggagccatcaaaaaggccttctcccagcctcctcaccaaccacggacattcctggcccaacaagacctcctggccaggttttgagccctgcttcccaggtaaaaacactgcctgtaccagagctctccatgaattttggtttaaattaggatttaaattcttctggcccttactaatgttaaaacccagcttttatgatttctccaggtagtattctttccttaaaataatccagactagctataggaaccaatcaggacattttgcccaagatctaggacagaaagactcatgcagtaactcctgccttacagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaaggtaggtgtgaaacctgagggaagtttttaggaataggctttaggccaggtacttaaatccatttgttcccaaccttggactccaaagataagggcatttgtagctggagtagaaaagaagggaacaatgagaactaagatttcatcctctgtgatgattcttatcattcaccgtccttcctctccagcatcaccagtgcagaaagtgcagaggacttatgtacccaatctttttttttttttttttttttttttgagatagagtttcactcttgatgcccaggctggagtgcaatggtgtgatctcagctcactgcaaccttgcctcccaggtacaaacgattctcctgtctcagcctcccaatatacccaatctttctcctttctatccaggccttctgcaagagagatctaagaaccagccctcaaagatggtaagggcttggctagtgacagcccagtctcagctccctgtgcccaaagtgtcggaacagggccactcaacccaagccctacatatatactctgggaagttgcagtgcctcgaagtgatcaggccatagtcctgtgaagactggggtcatccatgtcccttcctgcctactcacaaacttctgttcttcctattcttttctttcagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaggcagttgggcccttcagagggcgtttggttgtgtttagactcggttgctttctaacactaattgcaggctcaaaaggagcggaatttattgcgaaggccaaggcggcttgtttataatttatgaagttttaaatggctgtgccgcgggccccaactttctcctgggctggcagccgcgcggaaacgcgccctcccccggcacgccgcccacccccacccacgcccctcagatgagtctcacgccaatggcaggaacagatccgagctattagaagtctcgggaacctccagagatgacagaaggtggcagatttggtccaagccctcaccccactcgagaggagggcgtcggggaaagctgtggctgcctggagagggagcccctgatcccacacttccttggagcctgagtgtgagaggaagctaatgtcagccgggctagacaccgtttaaagtctaatccatgaaaccctaagccgcaaatgacacttggggctttgcagacacccgcagactcagcagatactcctgcggtaacacactgtgctggaaaacgcctggagccatgacacattacgtatttttattattatttatggtaggaagaggagatgagggaaaatcgggctgaatctaagcagcctgacaattcagctagttaatatttagccagttaagaaaggtggttgtaatccctgcaaggcagtgagctctcctttgatttctctaatagcttaaaaaataatttcttacaagacaattagaaattctgcctatggatgcaaatttcatagaaaacaatgttaagccttgaaagtgggtaaaatgtgccttcgattgaagtcatttattctgttgatacacttctacaacatatatattttaaacctgctcagataaagtgaaatttagcaaaaggatatcccctcccacccccaaatctaacatgccattttaaaaacagcacaaaggaacaaggaaactaaatattattttgagccatcattacttagtgaaatacaaacatccaaatagaaacgattgttgttccaccaaaagattagaagttaaattatttccacacaataggaatttcacttcgtgtcatcggggatgtagtaggagttgcattatttgtcaaaccaaatagagatgcgtgggctgactttgctgaaatacaaaagaattgaaccttatctgaaggcgttttctaagtggcccctcccatagaagccgggaagttgtccacccctagcagaagccacattaatatttacaaaatggttataaatccttgaagacatttttgcccattttgtataagaaacaggagtaaacaaggtgtttatacttgttatgtttcattaatgaaatattattactttacatcttggggaatgtttgttttctttagaaatgaactaatgatcactacaaaggaagaattcatgacagcatttcctagagaaaaagcttaggtacgcgtctccaaatgatggtttctttttctacaccttagctttttcatagctcaattcttcttacaacttctcttgtgttttttctttgattgtcagttttctttcaaagtttattttttgttacttaatgcagaaaagtgagctctggtctccccagtgtaaaagtcgattgtgtctagaaagaaggcagtaaaaacagcaaagcaggcgctgctttcaaaaagccctgcccaaatcatcccgcccagaaccttcttaggtttgcatcctcatttccccctcccctaatttcaatagctggaaagtaatcaagtatcccgagaaccaatttatgcactagactccaaataaataaaatatttttttcaaagtgtca

SEQ ID NO: 14251 - DNA, 9013 bp, Homo sapiens
gactgggaaatttttttattctaaatatttgttccaatagtaccagacaatttgaaatcaataaactgtggtgaggactgtggtttttgagaaatgaccaaagtgtgttgtgccacgccaccgggcttcctgactctacccatgaaggacaatttgcggtcttaatcctttatgtcaactacaaacaccagccacggttacgactgttcaaaactactctctcaactagttcagaccagggggactaaggaggtgaaatgtggcccccacggcctggaagcgaattcctaagctcggctggataaatctacaaatatacacataaatacattcagacaaggataaataatcagggaacgaaatgactcgcttcaaataataaatacagatagtttagtccgatgcaatccttacggcacaggaaggagaatataaattaaggtctctgaaactaagctagacgcgggccaggcccaagactctccaagctctggtccctctgcagggcgcgccgctgatgggtctcagacttacctttgggacaccattaccagattggagtcccttggtccgcagtatgtggcactgtcaaatttacagggaaggatccttgcggctgatttatggcgagtcacccaaaggacgcccatggaggggaggcccggtcgcctgcgcctccgccgctggaggcctgagacccgggaggcggcggcagggcaagagcggggaagggggttcccgaactgccccgcgggccccaccctctaccccaccactacagcaagagaggtaattttgccgcgagttcgggctggcggcggccgctacagatgcgtcagtttgggagcctccggcagtcgtccctgagacgagtggtgggccgagagatctgtgtaggtgggatgagggtcgcaaggtccatggtggtggttgcctggaatctgcgcggcgcaactgtagtccacgctggccgacgacgggtgcgagaggtggcccaggttgaagacaggcccggacgcgggcgccatggactcgacgaagttgccgcccacgtacaccgggctgccctgcaagttggcgctggcgaagccgccgccgttgctcgccatgggatggggctcgaactccggcgctgcgtagcgcttctgttgtggcaggcagctgctgagtggcgccgtgtaggcggccaggccgtacatattgggctgtgatttggcgaaagcaggcggcgagggcgcgtcgtaggccaggccgggcactggcggcagctggccggagtaggccacgtggccagcggcgccgccgagcggtgggctgcgctcaggggactggctagccggcgagtgcaggatgcccttggccttctggtccttcttgtacttcatgcgccggttctggaaccagatcttgatctggcgttccgtgagattcagcaggttggccatctccacgcggcgcggccggcacaagtagcggttgaagtggaattccttttccaattccaccagctgcgcgctcgtgtatgccgtgcgtacccgcttggatgctgggcctggcgggctcttgtcctcgcagctctctcctgggcagggagggagagagggagggcgctgagcgagtgggtggggaccctcaggactggagaggggtgcttccctggttctcttttcctcctccctccccccacctccaatcctggctggggaggggaagggccgtttgagaggtatgattccaagggggaattcacctacctaccaaccccctactaggcctacctatcagtcgcacctgaaacctccatcagccttctgagatccagttcactctgcccaccctctcccctgcagcctagtccatcatcccatacccacccaaaggccatgaaagagtttaatgagagaccaggagcagctggtaaggcctccctctgtcaaagaagggccagactcctttgaacactcctcccagcctctgctgccaggggtggggtatggagaaggaaaggaagaggaaatagctccagcctgccttgcttaggagctggcctctgggcaaagccccccaccaacccccagcaaagtatggggatggagatcttggcgccccactgcagcccaactgcactcaaagccagggaggtgacaaaccaaaaaataaaaaataaaaaaaaaccaaccaaacaaacaaacaaaaaaaaacactgcctgggtattttagggagtccaaggccaggctggaagcattttgagtattcacagtgctaggagcagcagcctcaacactggcttttactaccctgccacctctcagctgcttgtccactccctcccagggaagacaaatggatttctcctgggagggagggcctgagcctgcagctgaggaaggaggggcaggaaaaggaggttgcaggcaggataataccctctccctaggagcagcagccccagaaaacatcaggcaaaccagatccctgatagcaagccacaccccaggccccaaacttgccctggacctggaagcaagttcatctacctgaagataaaccacatcagataccacaaggtcagaaaatttcaggaaccaagcagtctaagcagagagaaggaacagccctcagagttcctggccatgcctatcttctacatgccctgggtggacctagagaaggccccaactggaggggctccccttccagttagagaaatccaaggctgttactgtctcccagaatatcctctcctactaggacaggcacctccccattatggatttgctggagtgggagaattgggctgaggtgggccaaatagagactcatggttatgcttagcagcccctaaagccagactgactggattcaaatccaccactttgcagtttcagaatcttgggcaagttgcctatcctctctaacagttttcttatctgtaaaatggggatgttatcatatacctacctcaaaaggttctttgaaaaattaaattagataatgcttagaaagtacttagtatggtactttctaagactttagtttttatgagtttaagggaatgagattcgtgtgatatgggctatataatcacctaggcttggggattgtaatacctatcttcaaatcttgaagagctgttgggtggaagagggaatggagttataattagcagcccaggaaaacagatatgcccatataaggaagcactctctattaatagctataagacctgtccagcaacagcaccagcagcctggaatggaagggagcaccctgtcactgcaaggtcatgaccccaatcaggaacactaaaaaaaagaacattttgacgtgagtaggagtttagacatatgacctccaaggttgcatttccagccctgactaggcttccttgggtcaatctggagggggcttggtctggcagtaggccacctcagggagctacctgcagtggcacagctgttcttctgcttggagttctgtcgagactctttcatccaggggaagatctgcttgctgatggtggctgaggagctagaagcattgggcccacctttgggcttcttggcaggcactccacctccaggattggtgggtgaagatgggggcagggtcggtggtggaggagggggttgtggtggctgctgctctgagttcagaccaggaggctggctgccaccacccccaccctggctgttcccagtgcccggccgcatgcagctgccattgagttcagctcctttgtgggctggggctctcagaggggcagagctctggatggagcaggcagaacctggatagtcagtgtccagggagctggcagcagcagggggtgggtagggctggtggggggtgctgtagccgtaagtgtccgtagttttgctgtagccatagcctccaaacagtcctgggttttcatagtaagcagccttctgcattgtgcactcaggaagctccagggcctgctgaccctgctcaaataacattgactaccactgtatccttcactgccacctccaatgtctgctgaatcctgagagagctgggccggcccccaggctccaggtgacctgtcagaagaaaagcaagaggccccagagggagtgtcattggcaagaccagtcaatatagaaggactagcccatgctctctgcttcctacccacttcacggcggggagatgggcaaggtgctggatctgagtttatttacttatctatttatttattaatacagtgtcttgcttgttgcccaggctggagtgcagtggcatgaacatggctcactgcagcctcaatttactgggctcaagcgatcctcccactttagcctggtattaatagctatttcagagtatttcaaagtcccagctattctgcagtattaatagctatttcagagtatttcaaagtcccagctattctgcagtattaatagctatttcagagtatttcagagtcccagctactctgcagtagctacaggtgcccaccatgcctggctacatgtcttagtgttttgttttgttttgttttagatggaattttgctcctgttgccaaggctggagtgcagtgtcatgatctcagcttactgcaacctacgcctctgggttcaagcaattctcctgcctcagcctcctgagtagctgggattacaggcacctgccaccacacctggctaattttttatatttttagtagagacagggtttcaccatgttggtcaggttggtcttgaactcctgacctcaggtgatcaacccgcctgggcctccctaagtgctgggattacaggtgtgagccactgcgccagctcttagtttttttttttttttttttgtagagacagggtcttacaatgttgcccaggctggtcttgagttcctgggctcttgtgatcctcccgtcttggcctcccaaagtgctggaattacaggcatgagccactgcgcctggcagattttatgaagttcaacttatttgaacctctggaagtatcagaaggaatttttcctaaatgtaagaagagtttccttctttttagctcaactgtagctgagggaaagggcttccctctacctccagatacaatttactttcttcaagattgtccatttagcctttcttctgtgtggaaaagtacttatagcctcagacattttgttggctgattcgcccactaaactgtaagctccttgcaggcaggggctgtgtcatttgtctactgttcctaacatccagcacagtgccctgcatgtagttagtgcaataaatgcttgttgaataggtgaattaataagtggatcaatcagtcaatcattgggtcagcacaaggttttgatgggaaatgaaagtcctataacatgctcagaacagccagaacttaaaaaaaaaaaaaaaaaaaaaaaaaaaaagggtctccccccacctggtttcaaaatcacagcatcttgcatgaaagtccagatagtccacttaacgatgacagggtgaaaatcagctgagtaagctctatgaatcagcagtgtaaaatctacaatgtagaaaactaggggataaacaccaacaggaggacttgcagacttccagactcattttgaggctagaaaatgtttcttctctttcatttacatttttctagaccttttacttttgacctcccctacttttaaacagataccactggaaatgggcaaagagatctagaatttgaaatgcatggaacatgggtgagtggagaatgctttataactttattatttttgccttggatctattgtataaatagatattattgacatctgctctggataatctattctaccctacctcccacccaaaccacaaccaatgagagaacctttcatgacatgatgaatggacccagaattagaagaagaaaaaaaagctaagaaaaatcctaccccttttgtattcccttctttatgggggtttcccttctctccctgcctccctacttcttctgaaaggctcctaaagagttaaagtataactaataccattcaatcactttgtctgtttgataaagaaaactcataggtcagctccctggtctcaattcttgatctgtctttcaggcaactttccttcctagaaactctccctggcttccatcctggtcatcatgatgtaccacatcatctagacagcttatgtggcctaatggatttgaccacaggtaccagaatgattcactagttttccctccacctgcaccaaacagcctaacccaaattttaaaattcttctaattagtctttggtaggtagtgttgttgccctttttgttttgtcttgttttagaatataagtgagtatgccatttgtcttgatgaggaacaggcccttaataccaagatactatgttgtagaaattgtttccattattgttcttaaatgtatgtaggtaggatatctacttaacaaagctggacttaatttttcttttgattaattttatatatcattctctgttaaaagttactggatatcaaatggacagctaagtcttcattctgtgactaatacttacatatgtttgccccctgctgaagaaagaggcactctggatttggttatgtttcaggcttttctggtatcctgctttcagtcttaaccctctggaggcctaatggtcacatcggacactcagactaccagaacttgctgctgctctgtcattccatttacaactgtggaagcaaaacattcaccctcctgcctcccaagttgacaaagttgatctagataggtgaaccagtcacgttaaaatagcttacttaggaactgaccagttcttctgggacagatggctttatatatatatttgcttctatggcatattcctagaaaaagttctgtgtacagacctcaaaagtacaaacattgggcatcttcctgaaaaaccagagtctgttttcctaactgtttacattgtctcaagaaatttcccactcaatgacaatccactaccttaatgtccatttccccaaaagcaagagccagtgatggtgctgtccttactggaaatggctttgcagtcccccaaaaatgcagtttcccaaaagtgatccctcttaaaacaaaacctgagaatatagttacaaaactggtaaaaaggcttatttcttttcagaaatccctactccttgtgaactctgcttgaacctaaaaagcaggaacgggtcataaatcacttggacaatggtcaactgttcagtggctcatcttttcgatcaccccctcaccctttttttaaagcctttcttttctcgccctttggtacctttgctcatttgggctccaagacccaaatgtcttggggtgaagatgagccagtgttgggggaggggtggtcgagcacggcttctcatttcttccaagtcctcagctgccctttcctctccctcctcctctcctccaccctctagcccggggaactggccagggcagcctccccaaactccgccggcgccatcccctgctcctcctgggaaaggggtgccaaataggtctggctcgccctttcttgcggtgctgggaagttgcccaactcagcttggaggcccaaccgcaggcccggaatacagggccaaacggtctcctgccggaaggaaggtattctctgagcggccaccgcccgcttccccgggcccgccggcccgccgcaaccgctgcgcctccaaagcagccgaaccctgatacttgctcaccgcacttaatgctactagagatcaatacctaatatgataccaaataaataaaaggcgctcacagcgaccaggggacggggttattaagcagctggagctctcacggtgcatatcaatgcacctgtcattgtggtttgtagcaaaatttatgactgcgaccacggcggcagtaaacgcttcggtaaggaatgaaaagaaaaacacttcccaaggcccggcacttttcagcagtggaaagcaggctccgcgtaggaggcagcgcagcaaaagaattccctactccgcacttttcccgctcttgcaccctgcgagcagcaggattatataaagtgaccggcgcctgcttctgctagcagctctgctcggcggtcggaggcgggacgaacgcgcgcagcctcgctggggaccaaaaatctgctgcccgtggtggcctcggacgccgggaggctagtccgacttgcggaggccggctcggcacttgcttgtacgccggtggcagtggaaaagctgagggggcttgggaagggaggggacaccaggcgccaggctgtgactagcgctgcaatcgtcgtaaatcaccgacgggtagagtcagcccatccaagttgaaagagagggggaaggcgatggaggttgcggtcagtttctctcaaaatccgctagtgctcgagctggtctcggcgcctccccctgttttgcctaaaccagggtcagaagcccacggatctctttctggcggccaagacttttgctgagcatccccacgaattcactggaaccgagcaacgattctccctttcctgttggctttgctacttcgggattcgaaaccactggtttttgggtttgctcgaaaggagacttctttacgttccgcccaagttctcccgatctctaagcttgagcctcttttgctctataagaagacctggacgcgccttctaaatcactcttatttagcccagataactcaatactgtaatgcaccctgtatttaaggcactgggcttgccccattaaagcgccataaatttgaaggccaatgatcggttttcatgtaacgggtggtacttcatactgaagtgacccacttcaaagctgccctttgttctatgtcttgatgtatgaattttgagatggccaccttgagttgcagagggaaatgtactggaaattattatttaaatgatgcccactcaccacaattatgtatgtgtgtgttttcttgaattttgtctttatctcttttttttttgtaggctcttcaggtttcttttgatatc

SEQ ID NO: 14252 - DNA, 566 bp, Homo sapiens
gactgggaaatttttttattctaaatatttgttccaatagtaccagacaatttgaaatcaataaactgtggtgaggactgtggtttttgagaaatgaccaaagtgtgttgtgccacgccaccgggcttcctgactctacccatgaaggacaatttgcggtcttaatcctttatgtcaactacaaacaccagccacggttacgactgttcaaaactactctctcaactagttcagaccagggggactaaggaggtgaaatgtggcccccacggcctggaagcgaattcctaagctcggctggataaatctacaaatatacacataaatacattcagacaaggataaataatcagggaacgaaatgactcgcttcaaataataaatacagatagtttagtccgatgcaatccttacggcacaggaaggagaatataaattaaggtctctgaaactaagctagacgcgggccaggccaagactctccaagctctggtccctctgcagggcgcgcccgctgatgggtctcagacttacctttgggacaccattaccagattggagtccct

SEQ ID NO: 14253 - DNA, 18408 bp, Homo sapiens
atgtgatgcatgctcacgtgtctccgcagccggctcgggaaagaatcccccaaggtaggtggccggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggtaaggtgcaacaatgagctgagtaatttgccagtgagcagtgggggtgccgagaggtcttaaccaaggcagagaatctgcaagaggtgggacccccagcttctgagttccacgaggaccccagcctgcactctcatgtgggtggcaggagaggctggaggatggtgcaggactcgggcaggggtgcccaagggaaacattttggttggagagtcaggaagccgcaccaagccttgtgaccttggacgaatcactctgtagacctctgtctctgtgacgtgagcagcggggaggagatggtcacagctctggcagtggtcactttgcagggttctttctctagctacactggaagcctgggagtcccaagactctgccttcgctgctcactgctttgattttgctgagttgctggttgggtgacaggatgtgtaagaggatgtgtaagccctgtgacatctgacagatctttctgggtttcgagccagcagaggaatgtttcctctggtgccatgtcccttggttccatgcttgataacagatggctgagagcacatgaactttcaccctttccctctcatgagtggatggtccccagctttgtttgtccatcatcaggaggagcaatgggaagtagtccaaggggtcttgttagtcattttaaacccccagtgggctgaaggcatcagagagggtggcccaatggttagggcagtcattatggctgaatatgctcagttccctttttttccctctgggctataaagactaaaccaggctgggggctgtggctcacgcctgtaatcccagcactttgggaggccgaggcagcaggattgcttgagcccaggagttcaagaccagcctgggcaacatagtgagacctcctcatctctacagaaaatttaaacatgacaggcgtggggggcttgtcacgtgggagaagtcacatgggagaagagttgagaattggcctgaattttgaaaggccaattttgttccccacaggaacaaaaaatttaaaaagttggccaggcgtggtggctcacgcctgtaatcctagcactttgggaggccaagggggatcacaaggtcaggagttcaagaccagcctggccaacatggcaaaaccccatctctactaaaaatacaaaaattagccaggcatggtggcgggcacctgtaatcccagctactcaggaggctgaggcaggaaagtctcttgaacccgggaggcagaggttgcagtgagctgagattgtgccattgcactccagcctgggtgacaaagcaagactccgtctcaaaaaaaaaaaaaattttaaaagttagctggctgtggtggcacaaacctgtagtcccaggtactcgggaagttgaggtgggaggattgcttgagcctggtagattgaggctgcagtgagccctgattgcgcactggcactccagcctgggcaacagagtgataccctgtctctaaataaataaagactaaaccagggagggagtagagattaaaatggagttttgtatgagtaccgtgaaatcgggactcaggaatgaggagactctaggagaaggagtctttggcagatttcgccagcctgggtggtaaccagctaatagcagcctctggggaagactgccctggctcctccctgcccccttagttcctgcccttgaaatctggccttcttcctgctctttctcccattagctatcccagggcctctgtgcccattgttacctggccaatagcaccaggctgtggtttgagttttgtttgtttgtttgttttgagatagagtctcactctgtcgcccagactggagtgcagtggcgtgatctgggctcactgcaaactctgtctcctaatttcgggcgattctcctgcctcagcctcctgcacagctgggattacaggggtgcaccaccacacctggctaatttttgtatttttagtagagatggggtttcaccatgttggccaggctggtctcaaactcctgaccccaggtgatctgcccacctcgacctctcaaagtgctggaattacagatgtgagccaccacacccggcccaggctctggttttgatcagtgttctgctccctgcttgcttagggctggagagtctcaggcatggtggtggtgggcaacatgggaaggggcatctgcagaaataacagcagcagtgaccatttattgagtcttaaacccttactgatattaacacacgacccacaggaacatatgatgtaaaggcctaaaggggcgaagtgacttgcccagggtcacacagataggcagcggaggagtcagcattctgacggcagaacctactcggagacccagatcacagccctgcccagggctgctcttgatctgggggtggacttgatgctttaggaccatcatttctctgcgggtctcaggctatgagctgaaccttgagaacactgaagatcctttttcagggctgggctcctcagagcctctcgagattcttggaagaaaaaaaactgcatctcaattgtgtttatccagagagcaaagagaatcagtcaggtgataagcctgttatctgagttctgccatacccaaggtaccatcttggacccaggagtggggcagatacaaacagatggatgccctatggtcagacaggcctgggtttgaatcccagctccaccactgaccgccatatgactgaggggagagtggttatcccctctgggattcagcttcctctttggtaaaatggtgactgtcatgtctaccttttagggctgcattgaggattgaatgagaaagcattccatagctgcagcaatagtggtttatagtgacaaacagcactgcatgtttggcactgatcattgtaatctagcccaggaaagcaagcctagtggccagtgagatgctagcacatgagagagtactgagaagaaaccagctagagtggttctgggcccctacatggctccaagaagagctcagtgagtgacccaggaaatggggaagaaataggacctaaaagggtggcggcaaaggagttgggagcattagaagcatgggatgaatcactgttttcctgaagacgcaaacatgacaggcatgggggcttgtcacatgagagaagagtcgagaattggcctgaatttcgaagggcctcgaaagccacagaattcagactccaggccaccgggaggcgtgctggactgtaatatgttgaatctcagttcttggtaaggggtccttttgggaccctgtggggtggaaacaggctgggaagccagacagatctggatccaaatcctgctatgcaacttgctaatatatgaccctgggtcagtgatgggatctctccgaaccttttgaccacaagaccatcctaaggattgaatgagataaagtatatccatgacacacctgcccgatgcggggcctctatcgagtgctgatgtgttagtacccattttatgttgacatctaactggtccattgagtctgtatgcctgaagcaagcatgatttgcacctgatctgtttctgtgtctgtctccccatactctggcacccagtgcactgtctgcacagaggcatacctgggtttggaccctacccatgtgatcttgggaaagttattacacctttttgtcccctagttcccccatcttaggataacagtagtgcctgcctttgtcccatctaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagtacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatggtgagtgcactggccgggagggcagaggtgcagttcagttgggcgctttgcctcaaaagggaggcttcgggtcagggatggccagtaagtgatacacgcactgctctcccctccctcacacatggcagacatgactaatctattctagtattctttcctgtgacccaaatgaggcttcagaagccttccaacaatcagagaaatttgaacatcaattacatctctaattttttaggtgtaacattgattttgtggtatgtttaaaaagagggcccttatcttttagaactacatactgaaatatttattgatgaaatgatatgatagcttatattggcttcacaataaatgcagagtgggagggaaggggaatgatgaaacaagttggccatgcattgatcatttttgaagctgagtgatggatacatgccagttctttttactattctctttacttttttctttgagatggagtcttgctttgtcacccaggctggagtgcagtggcccgatctcggcttactgcagcctctgcctcccagtttcaagtgattctcctgcctcagcctcccaagtcgctggcattacaggcacccaccaccatgcccagctaatttttgtatttttagtagagacggggttttaccatgttggccaggctggtctcaaactcctgacttcaagtgatcctcctgcctcagcctcccaaagtgctgggattacaggcatgagccatcgcatccagcctattctctttacttttgtatgttggcaatttttcaaaaaactttttgtttttaaagaaaatctcaactcggcatcctctagcagtctcttaaaattgcctttgtgagatttgccaagcttgctttgggcactggcccagtaaatgctaggcgagcccagggtgccctctgctgccaggcctttgccacaagctcttgttctgcctctgcctgcagggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagagtgagcttctccctcagtccctaccccatctcttcttatcagccccagggatcctggggtggagggaaaaggcactgaacacctctccaggacttacctgggcccagcattcatctgggaatcctccctccaggcagagggaggtcctggggcccagcagagcaggagggccacaccccatggtggcctggcttgacattccctccttcctccctgtgcagttatagctgtgatggcgaaagagccggagggggccagcggcccttggtacacagaccgcaagttcaccatcagcctcactgccttcctcttcatcctgcccctctccatccccagggagattggtttccagaaatatgccaggtttggaggccccagcctgggtcagacagaagctatgatcctgggcagctgtagacccaagggctcctggggaaccctgctcctccatgccacctcaccttggggagcaagagtaggcaaggcagggcagaccggggcttgcagggtttcagataagaccatccttttctgtctccatcatagaaaaaggatgcatccatgagagattcagttctaaatgtccttttgcatccatgagtagttcagttctaagtgcccttgtcaaagaaggaacaggtggtatctgggcggtgaaggcagcctcctggcattccctgggaggaatttgggtctttgagactgtcagcctaccagcatcttacctgcagcttggcatgaaggaaggagactggtttcctgtctcggtgtctgaaaggctgtgggattctaggcttccccgtctgtaagtgcaggggccatgctccgctctctccaaggctcccataaatgttgacacaaaagtgtctgtactctcaaccctcttacctctggcatctcttagttctcaaaggccaggctcagaggatggtctcccacagcccctgcccgggctgggctgctctgattcaagtcccaggtgtgctttggagctctgctctctgcatcgtctctgagccatggagctgaaccagcacttcctgatggccaggaatgctgatcaggtcccctgttggctgtccagctccttcctagctgtggcaggtttctctgaaactacttctcaggcgtttcctgagtctgcttggcatagtctccggttcattcagtggacacttgtggtcgctagagctgaaggtggatgtccctaggggtggaatcagataagaggcagctggggatgaggacacttagtctctccttcccggcagcttcctgagcgtcgtgggtacctggtacgtcacagccatcgttatcatcaagtacatctggccagataaagagatgaccccagggaacatcctgaccaggtgagggtgagggccctaggagacatggggaagaagccaccacttgggccccagcaggtgctgggtcaggaaccagaaggccacacaggtgctcttctcaaggctcatgagctcatcagggctgacttggtcattgtaggaaggaggaaagagcccctgctctgatgttactggaaggaagagcaagaatcagagacaggaggcactttgccacctacatccaacagatgagccagtgtgaggctaggccttgggttgtggaggaacctgagggtggaatcccagggtcgaattgcctgtgtttccagcatctgcttatctgtaatttctgtatctttgagggtgaatttattattaaaaaaaaagggggggggccaggcacaatggctcacgcctgtaatcccagcacattgggaggccgaggcgggcggatcatgaggtcaggagattgagaccatcctggctaacacggtgaaaccccgtctctacttaaaaaatacaaaaaaattagccgggtgtggtggcaggcgcctgtagtagcagctactcgggaggctgaggcaggagaatggcgtgaacctgggaggcagaagttgcagtgagccgagatcgcgccactgcactccagcctgggtgacagagcaagactccatctcaaaaaaatacaaaacaaaacaaaacaaaaaaaacaatttccttcttttgaaaggaacaaaccagtaaagcaaaagccccagtccaggagccaggaattctggattttggccccaggggggcttttctgaacctccaggccccatcccagagggccctgggacataaggatgcctcttctccctgttcccagacttctgtgggttgaagctatggaatcccagttgctggagaccatggtgggctgaccgaagagtgagggcgtggggtgggttgtggctctgaggggttcccaggtggcagcaccatgtgtgtttgttcacaggccggcttcctggatggctgtgttcaatgccatgcccaccatctgcttcggatttcaggtgccagtgccagttgcaaggtccctgctgtccccttagatcaccccaccctgggatggaacccagcaaggaggaggaacccaggcagaatggaggaaatcctggggggaaggatggaacaggggcctcaggacttgccccttgttcctggggtctttgttcccaaggtaccttcctctggaaactggggttgaggtcatttccccaccatgacggtgcccttcacctggacagtgccacgtcagcagtgtgcccgtcttcaacagcatgcagcagcctgaagtgaagacctggggtggagtggtgacagctgccatggtcatagccctcgctgtctacatggggacaggtgagtgctccccccccccaagacctgggactagagtgctctcacttccacaggagtccctaggtcctggggcctagctttcctggggacagccctgcattcccagcatgacttgtataggcattggcttgaacttggcctgcctggagcctcctcctgccaagatgagagtggtgtattcatccattcattcaccagttctaacttggtgcctaggaagtgccaggaacggttctcagcatgggggatgccatggagagagacagaactggtcttgccctcatggagttgacattcttgttggagagacagtcatgcaggagtaactggggaatcagtaaggaattccagatggtggcaagcatcctgatgacagtgaaatagggaaggtgtgttttgttttattctattttattttgttttgagaaagggtctcagaaactgtcgcccaggctggagtgcagtggcatgatgatagctcactgcaacctcaacctgctgaggtcgagtgatcctcctgcctcagcctccagagtagctgggactacagccatgtgccattgtgcccagctaatttttttttttttttttttctagcagagacaaggtctcactatgttgcctagcctggtcttgaattcctgggctcaagcaattctcctgcctcggcctcccaaagtgctggggttacaggcatgagccaccaacccagcctaaaatggggaaggtatgaatgggactggatgggtggctttgggagtggttcacagaaggttcttctcagagaaggcccaaatgatgagaaagagccagaagaggaggagctggggaagaagggttccaggcagaggaaccacaaaacaccaaatcactgaggcagggccaggaagaaagtctatgtggctggagtggtgtgtgatgggggcaggtgaaggcagtgaggccagacaggcactggcagccagatcctgttgggcctcgagggctgctgggagtcatcgaggaagtgttttaagcaggggggtggttcggggaaaggtggctctggctgccgtgtggagagtggttggggtgagggagcaagtctaggagaccctggaagaaggatcccctgagttctttccacggatagaccgtaggagctgcctgggccaatactgttctagcctctgaatacacagccaggaacaagagaggcaaacagccaaatccctattctcctggggctcatgtcctggctggggagacagaaaataagcctgtaaaaattaattactattattattgttattatttttatttgtattattgtttacttaaagaccagtgtgatagtacagttaaaaaaaaattagaaagcgatgaggccagtcacagtggctcacacctataatctcagctatgggaggccaaggtgggaggttctctggagcccaggagttcaagacaggctgggcaacatggtgaaactccatctctacaaaaaatttaaaaattagccaggttatggtaacatgcacctgtggacccagctacttgggaggctgaggtgggaggatcgcttgagcctatgagatcaaggctgtagagacccatgatcatgccattacactccaaactgggcaacagagtgagaccctgtctctaaaaaagagagaaatgagtgttaggggacaggcccagtggatcatgcctgtaatcccaacactttgaaaagctgagatgggagaaccgcttgaggccaggagttcaagaccagcctcggcaacatagtgagactcatctctacaaaaattaaagaattagctgggcgtccgccaggcatggtggctcacgcctgtaatcccaggactttgagaggccaaggtgggtgaatcacttgaggccaggagttcgagaccagcctggccaacatggcaaaaccctgtctctatcaaaattacaaaaattagccgggcgtggtggtggtgcctgtaatcccagctactcgggaggctaaggcatgagaatcacttgaacctgggaggccgaggttgcagtgagccaagatcgcgccgctgcactccagcctgggggagaaagtgagactctgtcttcaaaaaaaaaaaattagccaggcatggtggcatgtgcctgtagtcccagtgacttgggaggccaagtcaggaggaacttgagtctaagaattcaagactacagtggaactatgattgtaccacttcactccagcctgagtgacagagcaagatcctgtctttaaaaaaaaaaaaaaaaacggccaggcactggggctcacgcctgtgatcccagcactttgggaggcccaggcaggcagatcacatgaggtcaggagttcgagaccagcccaaccaacatggcgaaaccccatcttactaaaaataaaaaaattagggctgggcgtggtggctcacgcctgtaatcccagcacttcccgaggcaggcggatgacgaggtcaggagttcgagaccagcctggccaacatagtgaaacctcatttctactaaaaatacaaaaattagtcaggcttggtggcgggcgcctgtaatcccagctactcgggagtctgtggcaggagaatcacttaaaaccagaaggcagaggtggcagtaagctgaaatcgcaccactgcattccagcctgggtgaaagagcaaaactccatctcaaaaaaaaaaaaaaattagccaggtgtggcggcaggtgactgtaatcccagctgcttaggaggctgaggcatgagaacccaggagaccaagatcatgccattgtactccagcctgggcatgacagagcgcgactccatctcaaaaaaaaaaaaaaaaaaaaaaaaaaaaaattagccgggcatggtgtaatcccagctactcaggaggctgaggcaggagaatcacttgaacctgggaagtggaggctgcactgagccgagatcgtgccaccgcgtgccagcctgggcaacaagagtgaaactccatctcaaaaaaataaaaaagaagaaggctgggtgtagtggctcacactctgggagggtgaggtaggaggattacttgagcccaggagttcaagaccagactgggaaacgtagcaagaccccatctctacaagaaaattagctgggtgtggtggcatctgcctgtagtcctagctacctgggaggctcaggtgggagaatcgcttgagccgaggaggtcaaggctgcagtgagccatgatcacactactgcgctctagtctgggtaacagggcaagactctgtctcaaaaaagaaaagaaaaataagacagcgtgatgtgagagagtgcctggggtgggggtcattgtagatggactggcaggaagcattctctgaggaaggacatctaaactgagacccaaatgataaggagatggcatctgaaggtctgccagacagaacagtcagtgccaaggcactgaggtgggaatgtgctgggcaagttcaggctcagaaagctgggggctggagggcttccagcgatgggggatctgagaagtcagggagggaggcatctgatcggagccccatctcccactctgagcctccgtctaagtgtccagagctgctgctgcagcctccaggctgatgttgctcctaggaggagtggacagtccaccccactaccctcccagggttgccctgacccagttgtccctgcccacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcccctcctagcccctgtgagcgcttccaacatggtcctttggccttgtgtggaccccatcctgtagaaggagaaactgaagcctgtagaaaagagtcggtgcctaggatgggtccctacatatcccaggccaggtgtcagaagcgccctttgtcctggggtcaccagaacattccgtgagtcctgtaagaatctctatccatggcatggcacggtggctcacgtctctaaacccagcactttgggaggctgaggcagaaggatcgcttgagcctgggagttcaagaccacctgggcaacctagtgagaccccatctctacacaaaataaaataaatagccaggtgtggtgggatgcacctgtggtcccagctactcagccacttgggaggctgaggcagaaggatggctggagcccaggagttcaaggctgcagtgagccaagattgcaccactgcactccagcctgggtgagagagccagaccctgtctcaaaaaaacaaaaaacaaaagaatctctatccagatcctttcctgagctttcacatggacaccctcccctttggatgccccagacagttccttttaaggaaaaaacaatatcagtttccatgtgatgtaaagcaaagtgctaagctctcgacattcaccgtctctagtccctgtggtaaacagagtgctggtggcccattttacagaagaggaaactgagggtcaggaatggggctttccccgcagtctacccagttaggggtctggctcctgtgagctagaggtggggagctgctagcagcaggggcacctctaagcccttctccatgtgggcagggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccaggtgcggacccctggcgccccatctcacagccccacagcacagactcccagggcctgcctagcctcagctccctacttgctcaaaacatgcaggagagagtaaccaccagcactaattgatcacctgtctcgcctctgtactagcccctatccaagcattatctcctggaaagaaggtatagttgtgatctccagtttactgatggcacgtggggctcagaaagggtcacagacttgcctagagcttaacaaactcaactagtaaccttttccatcccacgctgtctgggtccagagtctattcttttaaccattcattcaggtgtctgctgctccttgactatgagggatctatctggctggttcagcccattacagcccagagggcagtggggtctggggtggcaccctgacacagacatcagggaacctgggttccagacacagatctaccgccagatccctggagaactgtcctgtctgcccagccatgagttccacccttttccagcttgtctctatccaggaagccaccctgaaagccccagctgctttgcttggagcaggggagccagatctgctgggaagtgtactaggaagacccctggggttgggccaccactgagtcaccattgagtgctgtccctttagctgagtctagcatgctgcccaaggggtcttgtcagatgccagcctgtcatgggagagcagatgccagatgaccccagcaggatgtggtgtgggggcagagatggaatttctagaagagtaaacatgggcctttctccatccagcactgcttcttgggaaaggaggtggctaggagggagggagccctctcccctcacaaatgctcagggccacttcttctctttcagggctgtgcctcattcaagccaaactctctgagatggaagaggtcaaaccagccaggtaaagcaggacccagcccttgatcctctcagggaggtgctggattggaatgtggctttgtgggggccttaaaacagataggagtcagaggcttgtgtacttagaaatcatgggtttttgttttgtttttttttttttgagccggagtctcgctgtgtcgcccagcctggagtgcagtggcacgatctcagctcactgcaagctccgcctcctgggttcacaccattctcgtgcctcagcctcccgagtagctaggactacagatgcctgccaccacacccagctaatttttgtatttttagtagagacgaggtttcaccatgttggccaggccggtctcgaactcctgaccttaggtgatcctccttcctcggcctcccaaagtgctggcattacaggcgtgagccaccacacccagccaggttgttgttgttttttttttaatacttttaaaaattcggtagtgtgctagttgttaacaatttaaacattaataaagggcttaatacaaaaagatggaagtccctcttcccccacaacccactcgcccccacatcctttctgagatagctccatgttaccagtatggtctgtgtcctcaaccacttctgtacatgtgtgcgtgtctgtgtacacatagctatggagatgtatacatagatgcagggctcttgttttgttttatgaaaagtggtttcagccaggtgcattggctcatgcctgtaatcccagcactttgggaggccaacatgggcagatcacccgaggtcaggagttcgagaccagcctgaccaacatggtgaaaccccatctctactaaaaatacaaaattagctgggcatggtggcacctgcctgtaatcccagctacttgggagactgaggcaggagaattgcttgaacccaggaggcggaggttgcagtgagccgagatcacaccattacactccagcctgggcaacaagagggaaactctgtctcaaaaaaaaaaaaaaaaaaaaaaaaaaaaagccatacaaacatgtctaaaaaagaaaaaaaattggccaggcacagtgactcacgcctgtaatcccagcactttgggaggccaagacaggcagatcacctgaggtcaggagttcgagaccagcctggccaacatggcaaaaccccgtctttactaaaaatacaaaaattacctggttgtggtggcgcatgcctgtagtcctagctcgggaggctgaggtaggagaattgcttgaaccccggaggcggaggttgcagtaagtggagatcgcaccactgcactccagcctgggtgatagcaaaactctgtctcaaaaaaagaaaaagaagaagaagaaaaaaaatcaccctttatttcttttttttttgtctttttttttttttttttttttgagatggagtttcactcgttgcccaggctggagtgcaatggcgcgatctctgctcactacaacaacctccacctcccgggttcaagcgattctcctgcctcagcctcctgagtagcttggattacaggcgcccaccaccacacccagctaattttttgggtttgttgttgttgttttgagatggaatctcgctctgtcacccaggctggagtgcagtggcatgatctcggctcactgcaacctccagggtatctgggattacaggtgcgcagcaccatgcctggctaatttttgtatttttggtagagacggggtttcaccatgttggctaggctgatctcgaactcctgacctcaggtgatccgcccaccttggcctcccaaagttctgggattacaggcgtgagccaccatacccagccattttttgtatttttttagtagagacggggtttcaccacgctggccaggctggtctcaaactcctgacctcaggtgatccacctgccttggcctcccaaagtgctgggattatagacatgagccaccacacccagcctaatttttctatttttagtagagatggggtttcgccatcttgcccaggctggtcttgaactcctgacctcaggtgatccatctgcctcggcctcccaaagtgctggaattacagacatgagccactgcacccagcctaatttttctgtttttagtagagatggggttttgccatcttgcccaggctggtctcgaactcctgacctcaggttgcccgccttggcctcccaaagtgctgggattacaggtgtgagccaccacacccggccggaaatcaccctttatttcaattccgttttatccctgttgctgttaattggtacatacatttgcagatgtctgctttttgtttcctttttttaatgaaatagaccacattccatgtgacgtgcttttttctgaacatctttccatcaggatgcctacattcgaatcgtggcatgatgtgaacaatcagttactcccattagatcttggtcttcttacctatggactagggacaatacacctggccccacactacctttgtattgaagtctttgggaagtaggaagtgctctaccaacaggagaagtgcgataattacagtaattaacagttatatatattgaagtctgcagtcatgggatgggatgactgatcagacctctctcaccctctgttctacagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggc

SEQ ID NO: 14254 - DNA, 18408 bp, Homo sapiens
atgtgatgcatgctcacgtgtctccgcagccggctcgggaaagaatcccccaaggtaggtggccggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggtaaggtgcaacaatgagctgagtaatttgccagtgagcagtgggggtgccgagaggtcttaaccaaggcagagaatctgcaagaggtgggacccccagcttctgagttccacgaggaccccagcctgcactctcatgtgggtggcaggagaggctggaggatggtgcaggactcgggcaggggtgcccaagggaaacattttggttggagagtcaggaagccgcaccaagccttgtgaccttggacgaatcactctgtagacctctgtctctgtgacgtgagcagcggggaggagatggtcacagctctggcagtggtcactttgcagggttctttctctagctacactggaagcctgggagtcccaagactctgccttcgctgctcactgctttgattttgctgagttgctggttgggtgacaggatgtgtaagaggatgtgtaagccctgtgacatctgacagatctttctgggtttcgagccagcagaggaatgtttcctctggtgccatgtcccttggttccatgcttgataacagatggctgagagcacatgaactttcaccctttccctctcatgagtggatggtccccagctttgtttgtccatcatcaggaggagcaatgggaagtagtccaaggggtcttgttagtcattttaaacccccagtgggctgaaggcatcagagagggtggcccaatggttagggcagtcattatggctgaatatgctcagttccctttttttccctctgggctataaagactaaaccaggctgggggctgtggctcacgcctgtaatcccagcactttgggaggccgaggcagcaggattgcttgagcccaggagttcaagaccagcctgggcaacatagtgagacctcctcatctctacagaaaatttaaacatgacaggcgtggggggcttgtcacgtgggagaagtcacatgggagaagagttgagaattggcctgaattttgaaaggccaattttgttccccacaggaacaaaaaatttaaaaagttggccaggcgtggtggctcacgcctgtaatcctagcactttgggaggccaagggggatcacaaggtcaggagttcaagaccagcctggccaacatggcaaaaccccatctctactaaaaatacaaaaattagccaggcatggtggcgggcacctgtaatcccagctactcaggaggctgaggcaggaaagtctcttgaacccgggaggcagaggttgcagtgagctgagattgtgccattgcactccagcctgggtgacaaagcaagactccgtctcaaaaaaaaaaaaaattttaaaagttagctggctgtggtggcacacacctgtagtcccaggtactcgggaagttgaggtgggaggattgcttgagcctggtagattgaggctgcagtgagctctgattgcgccactgcactccagcctgggcaacagagtgataccctgtctctaaataaataaagactaaaccagggagggagtagagattaaaatggagttttgtatgagtaccgtgaaatcgggactcaggaatgaggagactctaggagaaggagtctttggcagatttcgccagcctgggtggtaaccagctaatagcagcctctggggaagactgccctggctcctccctgcccccttagttcctgcccttgaaatctggccttcttcctgctctttctcccattagctatcccagggcctctgtgcccattgttacctggccaatagcaccaggctgtggtttgagttttgtttgtttgtttgttttgagatagagtctcactctgtcgcccagactggagtgcagtggcgtgatctgggctcactgcaaactctgtctcctaatttcgggcgattctcctgcctcagcctcctgcacagctgggattacagggggtgcaccaccacacctggctaatttttgtatttttagtagagatggggtttcaccatgttggccaggctggtctcaaactcctgaccccaggtgatctgcccacctcgacctctcaaagtgctggaattacagatgtgagccaccacacccggcccaggctctggttttgatcagtgttctgctccctgcttgcttagggctggagagtctcaggcatggtggtggtgggcaacatgggaaggggcatctgcagaaataacagcagcagtgaccatttattgagtcttaaacccttactgatattaacacacgacccacaggaacatatgatgtaaaggcctaaaggggcgaagtgacttgcccagggtcacacagataggcagcggaggagtcagcattctgacggcagaacctactcggagacccagatcacagccctgcccagggctgctcttgatctgggggtggacttgatgctttaggaccatcatttctctgcgggtctcaggctatgagctgaaccttgagaacactgaagatcctttttcagggctgggctcctcagagcctctcgagattcttggaagaaaaaaaactgcatctcaattgtgtttatccagagagcaaagagaatcagtcaggtgataagcctgttatctgagttctgccatacccaaggtaccatcttggacccaggagtggggcagatacaaacagatggatgccctatggtcagacaggcctgggtttgaatcccagctccaccactgaccgccatatgactgaggggagagtggttatcccctctgggattcagcttcctctttggtaaaatggtgactgtcatgtctaccttttagggctgcattgaggattgaatgagaaagcattccatagctgcagcaatagtggtttatagtgacaaacagcactgcatgtttggcactgatcattgtaatctagcccaggaaagcaagcctagtggccagtgagatgctagcacatgagagagtactgagaagaaaccagctagagtggttctgggcccctacatggctccaagaagagctcagtgagtgacccaggaaatggggaagaaataggacctaaaagggtggcggcaaaggagttgggagcattagaagcatgggatgaatcactgttttcctgaagacgcaaacatgacaggcatgggggcttgtcacatgagagaagagtcgagaattggcctgaatttcgaagggcctcgaaagccacagaattcagactccaggccaccgggaggcgtgctggactgtaatatgttgaatctcagttcttggtaaggggtccttttgggaccctgtggggtggaaacaggctgggaagccagacagatctggatccaaatcctgctatgcaacttgctaatatatgaccctgggtcagtgatgggatctctccgaaccttttgaccacaagaccatcctaaggattgaatgagataaagtatatccatgacacacctgcccgatgcggggcctctatcgagtgctgatgtgttagtacccattttatgttgacatctaactggtccattgagtctgtatgcctgaagcaagcatgatttgcacctgatctgtttctgtgtctgtctccccatactctggcacccagtgcactgtctgcacagaggcatacctgggtttggaccctacccatgtgatcttgggaaagttattacacctttttgtcccctagttcccccatcttaggataacagtagtgcctgcctttgtcccatctaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatggtgagtgcactggccgggagggcagaggtgcagttcagttgggcgctttgcctcaaaagggaggcttcgggtcagggatggccagtaagtgatacacgcactgctctcccctccctcacacatggcagacatgactaatctattctagtattctttcctgtgacccaaatgaggcttcagaagccttccaacaatcagagaaatttgaacatcaattacatctctaattttttaggtgtaacattgattttgtggtatgtttaaaaagagggcccttatcttttagaactacatactgaaatatttattgatgaaatgatatgatagcttatattggcttcacaataaatgcagagtgggagggaaggggaatgatgaaacaagttggccatgcattgatcatttttgaagctgagtgatggatacatgccagttctttttactattctctttacttttttctttgagatggagtcttgctttgtcacccaggctggagtgcagtggcccgatctcggcttactgcagcctctgcctcccagtttcaagtgattctcctgcctcagcctcccaagtcgctggcattacaggcacccaccaccatgcccagctaatttttgtatttttagtagagacggggttttaccatgttggccaggctggtctcaaactcctgacttcaagtgatcctcctgcctcagcctcccaaagtgctgggattacaggcatgagccatcgcatccagcctattctctttacttttgtatgttggcaatttttcaaaaaactttttgtttttaaagaaaatctcaactcggcatcctctagcagtctcttaaaattgcctttgtgagatttgccaagcttgctttgggcactggcccagtaaatgctaggcgagcccagggtgccctctgctgccaggcctttgccacaagctcttgttctgcctctgcctgcagggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagagtgagcttctccctcagtccctaccccatctcttcttatcagccccagggatcctggggtggagggaaaaggcactgaacacctctccaggacttacctgggcccagcattcatctgggaatcctccctccaggcagagggaggtcctggggcccagcagagcaggagggccacaccccatggtggcctggcttgacattccctccttcctccctgtgcagttatagctgtgatggcgaaagagccggagggggccagcggcccttggtacacagaccgcaagttcaccatcagcctcactgccttcctcttcatcctgcccctctccatccccagggagattggtttccagaaatatgccaggtttggaggccccagcctgggtcagacagaagctatgatcctgggcagctgtagacccaagggctcctggggaaccctgctcctccatgccacctcaccttggggagcaagagtaggcaaggcagggcagaccggggcttgcagggtttcagataagaccatccttttctgtctccatcatagaaaaaggatgcatccatgagagattcagttctaaatgtccttttgcatccatgagtagttcagttctaagtgcccttgtcaaagaaggaacaggtggtatctgggcggtgaaggcagcctcctggcattccctgggaggaatttgggtctttgagactgtcagcctaccagcatcttacctgcagcttggcatgaaggaaggagactggtttcctgtctcggtgtctgaaaggctgtgggattctaggcttccccgtctgtaagtgcaggggccatgctccgctctctccaaggctcccataaatgttgacacaaaagtgtctgtactctcaaccctcttacctctggcatctcttagttctcaaaggccaggctcagaggatggtctcccacagcccctgcccgggctgggctgctctgattcaagtcccaggtgtgctttggagctctgctctctgcatcgtctctgagccatggagctgaaccagcacttcctgatggccaggaatgctgatcaggtcccctgttggctgtccagctccttcctagctgtggcaggtttctctgaaactacttctcaggcgtttcctgagtctgcttggcatagtctccggttcattcagtggacacttgtggtcgctagagctgaaggtggatgtccctaggggtggaatcagataagaggcagctggggatgaggacacttagtctctccttcccggcagcttcctgagcgtcgtgggtacctggtacgtcacagccatcgttatcatcaagtacatctggccagataaagagatgaccccagggaacatcctgaccaggtgagggtgagggccctaggagacatggggaagaagccaccacttgggccccagcaggtgctgggtcaggaaccagaaggccacacaggtgctcttctcaaggctcatgagctcatcagggctgacttggtcattgtaggaaggaggaaagagcccctgctctgatgttactggaaggaagagcaagaatcagagacaggaggcactttgccacctacatccaacagatgagccagtgtgaggctaggccttgggttgtggaggaacctgagggtggaatcccagggtcgaattgcctgtgtttccagcatctgcttatctgtaatttctgtatctttgagggtgaatttattattaaaaaaaaagggggggggccaggcacaatggctcacgcctgtaatcccagcacattgggaggccgaggcgggcggatcatgaggtcaggagattgagaccatcctggctaacacggtgaaaccccgtctctacttaaaaaatacaaaaaaattagccgggtgtggtggcaggcgcctgtagtagcagctactcgggaggctgaggcaggagaatggcgtgaacctgggaggcagaagttgcagtgagccgagatcgcgccactgcactccagcctgggtgacagagcaagactccatctcaaaaaaatacaaaacaaaacaaaacaaaaaaaacaatttccttcttttgaaaggaacaaaccagtaaagcaaaagccccagtccaggagccaggaattctggattttggccccaggggggcttttctgaacctccaggccccatcccagagggccctgggacataaggatgcctcttctccctgttcccagacttctgtgggttgaagctatggaatcccagttgctggagaccatggtgggctgaccgaagagtgagggcgtggggtgggttgtggctctgaggggttcccaggtggcagcaccatgtgtgtttgttcacaggccggcttcctggatggctgtgttcaatgccatgcccaccatctgcttcggatttcaggtgccagtgccagttgcaaggtccctgctgtccccttagatcaccccaccctgggatggaacccagcaaggaggaggaacccaggcagaatggaggaaatcctggggggaaggatggaacaggggcctcaggacttgccccttgttcctggggtctttgttcccaaggtaccttcctctggaaactggggttgaggtcatttccccaccatgacggtgcccttcacctggacagtgccacgtcagcagtgtgcccgtcttcaacagcatgcagcagcctgaagtgaagacctggggtggagtggtgacagctgccatggtcatagccctcgctgtctacatggggacaggtgagtgctccccccccccaagacctgggactagagtgctctcacttccacaggagtccctaggtcctggggcctagctttcctggggacagccctgcattcccagcatgacttgtataggcattggcttgaacttggcctgcctggagcctcctcctgccaagatgagagtggtgtattcatccattcattcaccagttctaacttggtgcctaggaagtgccaggaacggttctcagcatgggggatgccatggagagagacagaactggtcttgccctcatggagttgacattcttgttggagagacagtcatgcaggagtaactggggaatcagtaaggaattccagatggtggcaagcatcctgatgacagtgaaatagggaaggtgtgttttgttttattctattttattttgttttgagaaagggtctcagaaactgtcgcccaggctggagtgcagtggcatgatgatagctcactgcaacctcaacctgctgaggtcgagtgatcctcctgcctcagcctccagagtagctgggactacagccatgtgccattgtgcccagctaatttttttttttttttttttctagcagagacaaggtctcactatgttgcctagcctggtcttgaattcctgggctcaagcaattctcctgcctcggcctcccaaagtgctggggttacaggcatgagccaccaacccagcctaaaatggggaaggtatgaatgggactggatgggtggctttgggagtggttcacagaaggttcttctcagagaaggcccaaatgatgagaaagagccagaagaggaggagctggggaagaagggttccaggcagaggaaccacaaaacaccaaatcactgaggcagggccaggaagaaagtctatgtggctggagtggtgtgtgatgggggcaggtgaaggcagtgaggccagacaggcactggcagccagatcctgttgggcctcgagggctgctgggagtcatcgaggaagtgttttaagcaggggggtggttcggggaaaggtggctctggctgccgtgtggagagtggttggggtgagggagcaagtctaggagaccctggaagaaggatcccctgagttctttccacggatagaccgtaggagctgcctgggccaatactgttctagcctctgaatacacagccaggaacaagagaggcaaacagccaaatccctattctcctggggctcatgtcctggctggggagacagaaaataagcctgtaaaaattaattactattattattgttattatttttatttgtattattgtttacttaaagaccagtgtgatagtacagttaaaaaaaaattagaaagcgatgaggccagtcacagtggctcacacctataatctcagctatgggaggccaaggtgggaggttctctggagcccaggagttcaagacaggctgggcaacatggtgaaactccatctctacaaaaaatttaaaaattagccaggttatggtaacatgcacctgtggacccagctacttgggaggctgaggtgggaggatcgcttgagcctatgagatcaaggctgtagagacccatgatcatgccattacactccaaactgggcaacagagtgagaccctgtctctaaaaaagagagaaatgagtgttaggggacaggcccagtggatcatgcctgtaatcccaacactttgaaaagctgagatgggagaaccgcttgaggccaggagttcaagaccagcctcggcaacatagtgagactcatctctacaaaaattaaagaattagctgggcgtccgccaggcatggtggctcacgcctgtaatcccaggactttgagaggccaaggtgggtgaatcacttgaggccaggagttcgagaccagcctggccaacatggcaaaaccctgtctctatcaaaattacaaaaattagccgggcgtggtggtggtgcctgtaatcccagctactcgggaggctaaggcatgagaatcacttgaacctgggaggccgaggttgcagtgagccaagatcgcgccgctgcactccagcctgggggagaaagtgagactctgtcttcaaaaaaaaaaaattagccaggcatggtggcatgtgcctgtagtcccagtgacttgggaggccaagtcaggaggaacttgagtctaagaattcaagactacagtggaactatgattgtaccacttcactccagcctgagtgacagagcaagatcctgtctttaaaaaaaaaaaaaaaaacggccaggcactggggctcacgcctgtgatcccagcactttgggaggcccaggcaggcagatcacatgaggtcaggagttcgagaccagcccaaccaacatggcgaaaccccatcttactaaaaataaaaaaattagggctgggcgtggtggctcacgcctgtaatcccagcacttcccgaggcaggcggatgacgaggtcaggagttcgagaccagcctggccaacatagtgaaacctcatttctactaaaaatacaaaaattagtcaggcttggtggcgggcgcctgtaatcccagctactcgggagtctgtggcaggagaatcacttaaaaccagaaggcagaggtggcagtaagctgaaatcgcaccactgcattccagcctgggtgaaagagcaaaactccatctcaaaaaaaaaaaaaaattagccaggtgtggcggcaggtgactgtaatcccagctgcttaggaggctgaggcatgagaacccaggagaccaagatcatgccattgtactccagcctgggcatgacagagcgcgactccatctcaaaaaaaaaaaaaaaaaaaaaaaaaaaaattagccgggcatggtgtaatcccagctactcaggaggctgaggcaggagaatcacttgaacctgggaagtggaggctgcactgagccgagatcgtgccaccgcgtgccagcctgggcaacaagagtgaaactccatctcaaaaaaataaaaaagaagaaggctgggtgtagtggctcacactctgggagggtgaggtaggaggattacttgagcccaggagttcaagaccagactgggaaacgtagcaagaccccatctctacaagaaaattagctgggtgtggtggcatctgcctgtagtcctagctacctgggaggctcaggtgggagaatcgcttgagccgaggaggtcaaggctgcagtgagccatgatcacactactgcgctctagtctgggtaacagggcaagactctgtctcaaaaaagaaaagaaaaataagacagcgtgatgtgagagagtgcctggggtgggggtcattgtagatggactggcaggaagcattctctgaggaaggacatctaaactgagacccaaatgataaggagatggcatctgaaggtctgccagacagaacagtcagtgccaaggcactgaggtgggaatgtgctgggcaagttcaggctcagaaagctgggggctggagggcttccagcgatgggggatctgagaagtcagggagggaggcatctgatcggagccccatctcccactctgagcctccgtctaagtgtccagagctgctgctgcagcctccaggctgatgttgctcctaggaggagtggacagtccaccccactaccctcccagggttgccctgacccagttgtccctgcccacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcccctcctagcccctgtgagcgcttccaacatggtcctttggccttgtgtggaccccatcctgtagaaggagaaactgaagcctgtagaaaagagtcggtgctaggatgggtccctacatatcccaggccaggtgtcagaagcgccctttgtcctggggtcaccagaacattccgtgagtcctgtaagaatctctatccatggcatggcacggtggctcacgtctctaaacccagcactttgggaggctgaggcagaaggatcgcttgagcctgggagttcaagaccacctgggcaacctagtgagaccccatctctacacaaaataaaataaatagccaggtgtggtgggatgcacctgtggtcccagctactcagccacttgggaggctgaggcagaaggatggctggagcccaggagttcaaggctgcagtgagccaagattgcaccactgcactccagcctgggtgagagagccagaccctgtctcaaaaaaacaaaaaacaaaagaatctctatccagatcctttcctgagctttcacatggacaccctcccctttggatgccccagacagttccttttaaggaaaaaacaatatcagtttccatgtgatgtaaagcaaagtgctaagctctcgacattcaccgtctctagtccctgtggtaaacagagtgctggtggcccattttacagaagaggaaactgagggtcaggaatggggctttccccgcagtctacccagttaggggtctggctcctgtgagctagaggtggggagctgctagcagcaggggcacctctaagcccttctccatgtgggcagggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccaggtgcggacccctggcgccccatctcacagccccacagcacagactcccagggcctgcctagcctcagctccctacttgctcaaaacatgcaggagagagtaaccaccagcactaattgatcacctgtctcgcctctgtactagcccctatccaagcattatctcctggaaagaaggtatagttgtgatctccagtttactgatggcacgtggggctcagaaagggtcacagacttgcctagagcttaacaaactcaactagtaaccttttccatcccacgctgtctgggtccagagtctattcttttaaccattcattcaggtgtctgctgctccttgactatgagggatctatctggctggttcagcccattacagcccagagggcagtggggtctggggtggcaccctgacacagacatcagggaacctgggttccagacacagatctaccgccagatccctggagaactgtcctgtctgcccagccatgagttccacccttttccagcttgtctctatccaggaagccaccctgaaagccccagctgctttgcttggagcaggggagccagatctgctgggaagtgtactaggaagacccctggggttgggccaccactgagtcaccattgagtgctgtccctttagctgagtctagcatgctgcccaaggggtcttgtcagatgccagcctgtcatgggagagcagatgccagatgaccccagcaggatgtggtgtgggggcagagatggaatttctagaagagtaaacatgggcctttctccatccagcactgcttcttgggaaaggaggtggctaggagggagggagccctctcccctcacaaatgctcagggccacttcttctctttcagggctgtgcctcattcaagccaaactctctgagatggaagaggtcaaaccagccaggtaaagcaggacccagcccttgatcctctcagggaggtgctggattggaatgtggctttgtgggggccttaaaacagataggagtcagaggcttgtgtacttagaaatcatgggtttttgttttgtttttttttttttgagccggagtctcgctgtgtcgcccagcctggagtgcagtggcacgatctcagctcactgcaagctccgcctcctgggttcacaccattctcgtgcctcagcctcccgagtagctaggactacagatgcctgccaccacacccagctaatttttgtatttttagtagagacgaggtttcaccatgttggccaggccggtctcgaactcctgaccttaggtgatcctccttcctcggcctcccaaagtgctggcattacaggcgtgagccaccacacccagccaggttgttgttgttttttttttaatacttttaaaaattcggtagtgtgctagttgttaacaatttaaacattaataaagggcttaatacaaaaagatggaagtccctcttcccccacaacccactcgcccccacatcctttctgagatagctccatgttaccagtatggtctgtgtcctcaaccacttctgtacatgtgtgcgtgtcatgtgtacacatagctatggagatgtatacatagatgcagggctcttgttttgttttatgaaaagtggtttcagccaggtgcattggctcatgcctgtaatcccagcactttgggaggccaacatgggcagatcacccgaggtcaggagttcgagaccagcctgaccaacatggtgaaaccccatctctactaaaaatacaaaattagctgggcatggtggcacctgcctgtaatcccagctacttgggagactgaggcaggagaattgcttgaacccaggaggcggaggttgcagtgagccgagatcacaccattacactccagcctgggcaacaagagggaaactctgtctcaaaaaaaaaaaaaaaaaaaaaaaaaaaaagccatacaaacatgtctaaaaaagaaaaaaaattggccaggcacagtgactcacgcctgtaatcccagcactttgggaggccaagacaggcagatcacctgaggtcaggagttcgagaccagcctggccaacatggcaaaaccccgtctttactaaaaatacaaaaattacctggttgtggtggcgcatgcctgtagtcctagctcgggaggctgaggtaggagaattgcttgaaccccggaggcggaggttgcagtaagtggagatcgcaccactgcactccagcctgggtgatagcaaaactctgtctcaaaaaaagaaaaagaagaagaagaaaaaaaatcaccctttatttcttttttttttgtctttttttttttttttttttttgagatggagtttcactcgttgcccaggctggagtgcaatggcgcgatctctgctcactacaacaacctccacctcccgggttcaagcgattctcctgcctcagcctcctgagtagcttggattacaggcgcccaccaccacacccagctaattttttgggtttgttgttgttgttttgagatggaatctcgctctgtcacccaggctggagtgcagtggcatgatctcggctcactgcaacctccagggtatctgggattacaggtgcgcagcaccatgcctggctaatttttgtatttttggtagagacggggtttcaccatgttggctaggctgatctcgaactcctgacctcaggtgatccgcccaccttggcctcccaaagttctgggattacaggcgtgagccaccatacccagccattttttgtatttttttagtagagacggggtttcaccacgctggccaggctggtctcaaactcctgacctcaggtgatccacctgccttggcctcccaaagtgctgggattatagacatgagccaccacacccagcctaatttttctatttttagtagagatggggtttcgccatcttgcccaggctggtcttgaactcctgacctcaggtgatccatctgcctcggcctcccaaagtgctggaattacagacatgagccactgcacccagcctaatttttctgtttttagtagagatggggttttgccatcttgcccaggctggtctcgaactcctgacctcaggttgcccgccttggcctcccaaagtgctgggattacaggtgtgagccaccacacccggccggaaatcaccctttatttcaattccgttttatccctgttgctgttaattggtacatacatttgcagatgtctgctttttgtttcctttttttaatgaaatagaccacattccatgtgacgtgcttttttctgaacatctttccatcaggatgcctacattcgaatcgtggcatgatgtgaacaatcagttactcccattagatcttggtcttcttacctatggactagggacaatacacctggccccacactacctttgtattgaagtctttgggaagtaggaagtgctctaccaacaggagaagtgcgataattacagtaattaacagttatatatattgaagtctgcagtcatgggatgggatgactgatcagacctctctcaccctctgttctacagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggc

SEQ ID NO: 14255 - DNA, 7071 bp, Homo sapiens
tgcagacgctggtctggttcctgctcaccctgctgctggcgctcttcatccctgacatcggcaaggtgatctcagtcattggaggcctggccgcctgcttcatcttcgtcttcccaggtgcggacccctggcgccccatctcacagccccacagcacagactcccagggcctgcctagcctcagctccctacttgctcaaaacatgcaggagagagtaaccaccagcactaattgatcacctgtctcgcctctgtactagcccctatccaagcattatctcctggaaagaaggtatagttgtgatctccagtttactgatggcacgtggggctcagaaagggtcacagacttgcctagagcttaacaaactcaactagtaaccttttccatcccacgctgtctgggtccagagtctattcttttaaccattcattcaggtgtctgctgctccttgactatgagggatctatctggctggttcagcccattacagcccagagggcagtggggtctggggtggcaccctgacacagacatcagggaacctgggttccagacacagatctaccgccagatccctggagaactgtcctgtctgcccagccatgagttccacccttttccagcttgtctctatccaggaagccaccctgaaagccccagctgctttgcttggagcaggggagccagatctgctgggaagtgtactaggaagacccctggggttgggccaccactgagtcaccattgagtgctgtccctttagctgagtctagcatgctgcccaaggggtcttgtcagatgccagcctgtcatgggagagcagatgccagatgaccccagcaggatgtggtgtgggggcagagatggaatttctagaagagtaaacatgggcctttctccatccagcactgcttcttgggaaaggaggtggctaggagggagggagccctctcccctcacaaatgctcagggccacttcttctctttcagggctgtgcctcattcaagccaaactctctgagatggaagaggtcaaaccagccaggtaaagcaggacccagcccttgatcctctcagggaggtgctggattggaatgtggctttgtgggggccttaaaacagataggagtcagaggcttgtgtacttagaaatcatgggtttttgttttgtttttttttttttgagccggagtctcgctgtgtcgcccagcctggagtgcagtggcacgatctcagctcactgcaagctccgcctcctgggttcacaccattctcgtgcctcagcctcccgagtagctaggactacagatgcctgccaccacacccagctaatttttgtatttttagtagagacgaggtttcaccatgttggccaggccggtctcgaactcctgaccttaggtgatcctccttcctcggcctcccaaagtgctggcattacaggcgtgagccaccacacccagccaggttgttgttgttttttttttaatacttttaaaaattcggtagtgtgctagttgttaacaatttaaacattaataaagggcttaatacaaaaagatggaagtccctcttcccccacaacccactcgcccccacatcctttctgagatagctccatgttaccagtatggtctgtgtcctcaaccacttctgtacatgtgtgcgtgtctgtgtacacatagctatggagatgtatacatagatgcagggctcttgttttgttttatgaaaagtggtttcagccaggtgcattggctcatgcctgtaatcccagcactttgggaggccaacatgggcagatcacccgaggtcaggagttcgagaccagcctgaccaacatggtgaaaccccatctctacttaataatacaaaattagctgggcatggtggcacctgcctgtaatcccagctacttgggagactgaggcaggagaattgcttgaacccaggaggcggaggttgcagtgagccgagatcacaccattacactccagcctgggcaacaagagggaaactctgtctcaaaaaaaaaaaaaaaaaaaaaaaaaaaaagccatacaaacatgtctaaaaaagaaaaaaaattggccaggcacagtgactcacgcctgtaatcccagcactttgggaggccaagacaggcagatcacctgaggtcaggagttcgagaccagcctggccaacatggcaaaaccccgtctttactaaaaatacaaaaattacctggttgtggtggcgcatgcctgtagtcctagctcgggaggctgaggtaggagaattgcttgaaccccggaggcggaggttgcagtaagtggagatcgcaccatctgcactccagcctgggtgatagccaaaactctgtctccaaaaaaagaaaaagaagaagaagaaaaaaaatcaccctttatttcttttttttttgtctttttttttttttttttttttgagatggagtttcactcgttgcccaggctggagtgcaatggcgcgatctctgctcactacaacaacctccacctcccgggttcaagcgattctcctgcctcagcctcctgagtagcttggattacaggcgcccaccaccacacccagctaattttttgggtttgttgttgttgttttgagatggaatctcgctctgtcacccaggctggagtgcagtggcatgatctcggctcactgcaacctccagggtatctgggattacaggtgcgcagcaccatgcctggctaatttttgtatttttggtagagacggggtttcaccatgttggctaggctgatctcgaactcctgacctcaggtgatccgcccaccttggcctcccaaagttctgggattacaggcgtgagccaccatacccagccattttttgtatttttttagtagagacggggtttcaccacgctggccaggctggtctcaaactcctgacctcaggtgatccacctgccttggcctcccaaagtgctgggattatagacatgagccaccacacccagcctaatttttctatttttagtagagatggggtttcgccatcttgcccaggctggtcttgaactcctgacctcaggtgatccatctgcctcggcctcccaaagtgctggaattacagacatgagccactgcacccagcctaatttttctgtttttagtagagatggggttttgccatcttgcccaggctggtctcgaactcctgacctcaggttgcccgccttggcctcccaaagtgctgggattacaggtgtgagccaccacacccggccggaaatcaccctttatttcaattccgttttatccctgttgctgttaattggtacatacatttgcagatgtctgctttttgtttcctttttttaatgaaatagaccacattccatgtgacgtgcttttttctgaacatctttccatcaggatgcctacattcgaatcgtggcatgatgtgaacaatcagttactcccattagatcttggtcttcttacctatggactagggacaatacacctggccccacactacctttgtattgaagtctttgggaagtaggaagtgctctaccaacaggagaagtgcgataattacagtaattaacagttatatatattgaagtctgcagtcatgggatgggatgactgatcagacctctctcaccctctgttctacagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcatttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctgagccgtgtcccctgtgtctgatcctggggacagagtccaggccactgccaggaggaagaagggctggggtaggaggtgtagatggcatgtcactgtctctgacccctatctccggaatggcaccgccatgctccctctaccaagcagggacctgcaagtggctcttgccacccctgctttcttccacattctacctatccttctccagtgacttaggaatgtatcgcagtctccaatcctgcgacctctgccttcacttaagccctcactgtctttcctgtgcctttgtggtctcagactgtccccctgacttcagatcttggcaagagctttaaactcctgagtatccacccccatcttttcagaggcgagcgttgagcaggtcccagctgtcttggttatggagccaccagtcaccacgctcagtgctggcaagaaaaccagcaaaggccaggtgtagtggctcacgtctgtaatcccagcactttgggagaacagggtgggcagatcacctgaggtcagaagtgcgagacaagtctggccaacatgctgaaaccctgtctctactaaaaatacaaaaattagctgggcatggcggcgcatgcctgtaatcctagctacttgggagactaagacaggataattgcttgaacccaggaggcagaggttacagtgagccgagatcacgccattgcactccagcctgggcaacaagagtgaaactctatcttaaaaaaaaaaaaaaaaaaaaaaaaaaccagcaaaacagactccagtactgctctcagcctagttgtgggaagactgatgctaagcaagcaatgacacaaatatacacttccaaattgtggttaagtgccaaggaaggaaaatacagtgtgttagtctgggggctggaaagttgtctggggagtcaaggaagacttcctggaggaagtgatgtttgagctggcctgtgactgatgagtaggaattagtaaagagaggtggggagactttgccaagcaatggaaac

SEQ ID NO: 14256 - DNA, 482 bp, Homo sapiens
cagccaagaacagaaccaggactggatgcccgtttcgtcattcaacaaatatttactgagcacctacaatccctcaaaaactgttctagagtctaaaccgatggggtcgtaaccatgcccccagcccactcccttgcaggaaagaccgtggctccaggtcccccacattactgattaaaaaaaaactccagtgctctggccatgggcgtgaaggcaaggacagagaccgggaggataatgaggccaaacagctttggcccaccgccaccgggactggcaaagaggccagacctcctaatgctcttccttggaggaaggagcagtgtttgatttggtcaagaggccaagactaaaagtaagaggataaacacgagctggctggacgcgaggctggctcagggcagtgctgtcgggctgaggattcagggagctggtgttgtccaagcttcacatttgcggaaactacaactcccagcgtgtcc

SEQ ID NO: 14257 - DNA, 1254 bp, Homo sapiens
gggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 14258 - DNA, 482 bp, Homo sapiens
cagccaagaacagaaccaggactggatgcccatttcgtcattcaacaaatatttactgagcacctacaatccctcaaaaactgttctagagtctaaaccgatggggtcgtaaccatgcccccagcccactcccttgcaggaaagaccgtggctccaggtcccccacattactgattaaaaaaaaactccagtgctctggccatgggcgtgaaggcaaggacagagaccgggaggataatgaggccaaacagctttggcccaccgccaccgggactggcaaagaggccagacctcctaatgctcttccttggaggaaggagcagtgtttgatttggtcaagaggccaagactaaaagtaagaggataaacacgagctggctggacgcgaggctggctcagggcagtgctgtcgggctgaggattcagggagctggtgttgtccaagcttcacatttgcggaaactacaactcccagcgtgtcc

SEQ ID NO: 14259 - DNA, 1254 bp, Homo sapiens; identical to SEQ ID NO: 14257

SEQ ID NO: 14260 - DNA, 1555 bp, Homo sapiens
cagataaccaaaccagactggaagaggataacaagatcccaaagaggaaaaaaaattgttcttccaggatgtcaaacctatctttgagatattcatcatccaaagggtcctggggttctctttttccaaatattaggataatgcaaatattcctgctcatggtggacgcacactgtgtttacatcagtcaacccttcaaacatgagtcagagaaatctttctctaaatgaaggtgccatttctattgacagctcaacttcgtaaaggtatgactttgagttgttttgactagtagaaagaaacatttgcccttttttgctctgtttctgtatttaggctttcacttgtcctagccaagattatttagatccccaatacggaaggtcaaatatgttaaatgctaaataattagattctcttgatttacacaaaaaaccataactaactaaaatagaaacttttaattatctgtattgttgtataaaatgttttatatattaggaatctaaaaatttgttttttgcttgtatcctctgtcataggaagaagacatcatgtctctgtttactgtaaccattaataaaggctaataacagacagtacatgatgatacttttaactagggcaaacaaaagtaatattttaacaatgaggtttggtctttgctatctatacctcatgtctaattttccctacaatgtaaatgtcattcctcctctctacccatttgtaagggtctcagttttctgctcttgcatgacttattttaaagggtcacaataaggccaggtaattcatattttaaaaattccatttagaataattacatctaaaaattcacaagaaagacaatttcaatataaaataataaattactaatattggaatttcaagcattagtcatggcaaaaaagagataatttgtagcagaatattttaatggcaactttcttattctatcacttattgtgttctatttgttatgaccaaagaaattactctatatccactacaattcataaaacaggcatgaggaagtctttttttcttggtgctcatgtctaagaagatgaacctcagaggtatgtcatttttcaatactatgttctgaacagacagcacacattatttttgaatggacaacaaaatctcaaaacatatatagagaggtatggtttgaggtgtgtccagtatgaggataatatgacccagcggatgtaaaattggattttattattaaaggaaaatggggtgtcttcaaaaagataaaacagcgggagttgggatgagtactgagaaaagagcacaaaaacaggcttgtagaggaggaagatctcaacagagctgactcttatctgtgctcacattcaaaactgacttttgaacaaaagctgcatcctttgccctatactatagtcccaactactctggaggccaaggcaggagaatcacttgaacctgggaggtggaggttgcagtgagccgagatcgtgccactgcactccagcccgcgcaacagagcaagactctatctcaaaaaaaaaaaaaaaaaaaa

SEQ ID NO: 14261 - DNA, 115 bp, Homo sapiens
tgaggcaggagaatcgcttgaacctgggaggtggaggttgcagtgagctgagatcgtgccactgcactccagcctgggccacagagcaagattccgtctcaaaaaaaaaaaaaaa

SEQ ID NO: 14262 - DNA, 1555 bp, Homo sapiens; identical to SEQ ID NO: 14260

SEQ ID NO: 14263 - DNA, 8297 bp, Homo sapiens; identical to SEQ ID NO: 7938

SEQ ID NO: 14264 - DNA, 665 bp, Homo sapiens; identical to SEQ ID NO: 7939

SEQ ID NO: 14265 - DNA, 434 bp, Homo sapiens; identical to SEQ ID NO: 7940

SEQ ID NO: 14266 - DNA, 21497 bp, Homo sapiens
aggaactcatggaggctgacaggggcagcatggcaccacagcagtttctaatttaagagcaggtgccgataagcagtctgaaaggagcttttggtacaataaagtgtatgagtaagtcacactgttctgtatatatgagacacacatgaggaattttctggagctattaatacagttcttgaatgttctgaattttttagagatctttctcatgaaaaaactttttcagattgataggttatatgattggaaaaagagtcctgactctgatgtggctgctactttaaagaagcagaaaaagaatacaaaagatgaatttgaggagcgagcaaaggctattattgtagaatttgcacagcaggtaagaaggccttccttctttctgaagagcctatctcagaatatgtattatattatctttataatgaagtcagcattttcattaatactggttcttttcctctgttgacagcaattactttttttaaattcttcttcccttttctcctttttctttgcagtctgaatactttaatttagaaaactgagttgacttagaactactttgctataatacagttaatgcttataggatatacatgatcatttttagtgtttatgaggagtttcaaaatgatgagccatttgctcatccggcttctagtgaggcacacctattccagatacgttttctttacagcctggcattttggatgatttttgctcctagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggtaatgatcaacttttcagtttattgttttttttttttttaaaaatagcaagttccttgagtggaggatatttactacttttagatttaatgaacatggtgcattgtatgtatgtctttctctttgcattaatgccttttaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaaggtatgctgaggtgggaagcattgacacgtggggacttgtacagtgtttagaagttctgctgagatggtttcctcactttgaaagctgtttgacttaatacagaacacatacatccctcgctctcccttttattttagttgtcatcatacaggaaggcctgtctgtcagagtagagatgtgtgaaagtacctgcttaccagactgggcctttgccagattctaaactacactgttatggttctacactgctaaatacggttgactcttgaacaacatgagggctaggggcactgactccctggccagttgaaaatccacatatattttttgactccccaaaaacttaactcctaatagcctaccattgaccagaagccttaccaatcacatacacagtcgactaacatgttttgtatgttttatatattacatactgcattcttacagtaaaacaagctagagaaaagaaaacgtgattaagaaaatcataaggaaaatagatttactatttgttaagtggaagtggatcatcataatggtcctcattctcatcttcatgttgagtaagctgagagggaagaaggagaggggtaggccttgctgtgtttggtggcagaggcagaagaaaatctgagtataagtggacatatgcagttcaagcccattttgttcaagggtcagctgtagttttttaacatttttaattgtgaaataaaacattgctcctgaaaagtacacacaacatagaagaaaagtttaacacatttttgggaagcaaccagatggagaatcagaacgctgctggcacccagaagcttcctgtgtgcttcttcctgatcaactcccctgccttcccctcctaccccctgacctttcatagagttaaccatggttgcattttatgacagtaacaaatatccttgctttgctttgtttttgtgtctaagagtacttcccttagaagtgtctgtagactttatgtagaaatggagttattctcagtgtgtacttttatagctggctctttttttttttttttttttggtgataggctctcactgtcacccaggctggagtgcagtggtgcagtcacagttcactgcagcctcaacctccccggggttcaggtgatcctcccacctcagcctcctgaatagttgggactataggtacgcaccaccacacctggctaatttgtttacagatgggactttgtcatgttgcccaggctggtcttgacctcctgggctcaagcaatccacccaccttgatctccccaaagtgctgggattataggcatgagccaccatgcctggcctatatctggcttcctttagtgaaaaaaaaaaagtatataattttaagatttctattccattgtgtgactatatcacaacatatctatctgttctgttgatgggaaatgtaggtgatctccagttttttatgtttattttattttattttattttgagatggagtctcagtctgtcatccaggctgggattacaggtgcacgccaccacacccggctaatttttgtatttttagtagaggtggggttttgccgtgttggccaggctagtctcgaactcctgacctcagcctccctaagtgagccaccgcacccggcccagtttttgatttttgttgttactaataatgctgctgctgtgaacatctcttgatgtgtttgtgccagtttcccagggtatgtatacctaggagtgaaggccacacttgtctacagtgggtgtaacaaattatattctcaactgcagtattttagtttcattgttttacagcttcatcagttcttggatgttaggttttaaattttttttgccattctgctaagtgtgtagctcattgccgtttcagtgtgcatttgcctaattgttaacctggttggtcatttaaaaatgtttattggccatttatttcctccttcgtgagatgtacatttttcttctgcattatctttcttacagatttatatgcgcttatatattcaggataccggtttgttagttggtgtgttttgcaatatcttctactcttgtgactttttttttcctgtggtattttgagaaatggaaatatttaattttaatgttaaatttatcagtcttgtgattattgctttttgtgcctcgtttaagaaacctctctctaatatcatgatgagattctcttatatcatcttctactgctaaccacttttaaagtacatttggtaacaaatgtttttatctctgtagaaccagtatgaaaagcataaagaagtagaagcagctcagggggtaaagattcttggaaaagacctggagaaaacattggctggtttacccctccttgtggcttataaagaagatgaaatccctgttcttaaagtaagttcatttaaaaatttttttccttaaaagctatttgagttctggcatgtgtcagcattgcacatgctagggatggtgaccaaaactggctttgtctttgtgaagcctgccatttcttggcctcttagcaaacttgatgcttttgaattacttcagtttgtacaatcatagaaattggtataatttttatatgtactagaattataaaaataatgcattttattcaaataaaaaaatgagtcaaaagctagaagtcggctgggcatggtgaatgcacacctgtagtcccagctacttgggaggctgaggcaggagaatcacttgaacctgggaggcagaggctgcagtgagccaagatcgtgccactgcactccaacctgggtgacagcaggaccctgtctaaaaaaaaaaaagctagaaattgtatattctttttggcccatgtccattgtagtttcataaaagtggactttgagccatagtttgttcatttgccaaagagaaaatacaactgttcccagcacatggctcttgtgtcctggggccgtgtttattatttaggcagcatcaagtcatgctgttgggaataagctatcttagggccagtgagagaatagggcaggcctgtctcttcacccagtcctgagtatggagtggacttacgtcccttcagtggcattgataaacttgttttacttatttctggttaaaaatctcttcttccatttcccgacaagcagtgatggaggaaggagctgctgagatcatgagattatggtatttcctagttaacacagacaagctgaacttttgggctatcataacacattacgtttatgtggtacttttttaactttaaaaaaatttttcttctctactgtttaattctgcccacccatctactgtatttgccaagtggagcggagattaaacatatttcaaagttagtaaacctaagacaaaggtgaagcgaaatacagttagggtatggccccgaaatctcctccttcattccagcacaggttctgtgatgccttgctctatctaagccttagtttcatatttgcagatgagtacttaaccaaagagagaaacacaatttaattctagactgctgaggatagaggtgtgttgacaaccttatcaaatctgatttcttttcaaggatgaattgatccatgagttaaagcagacactaaatgctatcaaattagaagaaaaaggagtctatgtccaggcatctacactgggttctttggaagctctactggaatttctgaaaacatcagaagtgcccgtaagtaactacaactcgctccacaagtgaatggtggttggtcgtggtttttggtgccatcgccattacctgatacatacagataaacatggaaactcccattttttcagtatgcaggaattaacattggcccagtgcataaaaaagatgttatgaaggcttcagtgatgttggaacatgaccctcagtaagtaatttctcttgctatgaaggctttcatgttacgtagctatcttaaaactgtcctatcttaaaaaactgtcctctgtgacatactctgtttttcactgaatggtctttgatgtgttttaaccttttaggtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagtaagttactgtttttatttactttgagtctttgttaatgaacatgattgagaattactgaattccagaaagggctgtaaacagcaaaatcatggcatttactcatctaccagaggctgcatcctgaaatggtgtgttacaaaccagaaacccaacatactggggacattccagcagtatgcaaacaagtcttgtctgtgacttcagtttaataatcttggcagacttgggtcttgttaatgggttcgtagttattaaatgtagggactttatgttgctcatctgggattatatagattggaagtaacaaaacttgagtgaggaaaaccgggaaataagagattctgtgggagagaagtccattcctctaccaaactttcactcaagcactcacagtacctacattgctgcagtggtagaggaggcatcagcagagaaccaggccagcctccctcctcctttccctttgagacagggtctcgttctgtcacccatgctgcagtacagtggcatgatcatgggtcaccccaacctctgcctactgggctcaagtgatcctcccaccttggcctcccgagtagttgagactacaggctcacaccactatgcctggctaattttttgtatttttggtagagatagggtttcgccatgttggccaggctggtcttgaactcctgagctcaagtgatccacctgcctctgcctcccaaagtgctgggattataggtgtaagccactgtgcctggtctgggacatgctcttattgcaggacaattgacacatgttgagaagtgctgaaaaaccaaataaagcagggaagggcctagataaggagaggagggactgtgattaatgatgtggtttgggaaggcatctcacctcttcagacagagtaagccacacaggcacatggggagtgtccagagagaacagcagtgcgaggcagagtgaccagaagggacagtgataaatgaggtcagagagggtggcaggacctgtatcgtcaaggatcttacaggccatgggagggattgagcttctctgagttttgcaagaagccattgccaaggctgtgtgttcacaatcagactggttaattgggttgttatgtggaccttgggttgttaggaagtcagtggcaagagcctgtcaggaggctcccacagtccaagcaagaggtctaggtgattcagaccacagtgatgataggagtgatggcgtagtttgggatacatttttaagtggagcttactagtaaatattaggatttagactggtatatgctcactttagatcatgaaacctgaagtgagaagaattctacttaacaagactgctggaaacttttaaagcattttaagcgtgtgctcaataagcagggtagttatgtagtggccttttggatcaatggtttgggaacgtggtggagaaaaggagggtgataatacggtctgatgcctatgtgatcccccagtagcctacatatgtgcctaacgaagacctgcctgtcaccaggtactgcctaggttctaagccccagactgtggctgacatcttcagcagccaagctcagtgttttagactaggaacagaatgctcctgtgatgcagcttcttttggaggtagggctttaaaagagaagaaagcaaagacttgggaagcaacagaatggggaggaggaggttaagaacaaggaagaagcgctctgggcatggggtggccctgggctgcagcaccctgcctgcccctctcctgtggccgctggggaaagctgctttcctctaatgggagaagcctgatgttcagctgcagtttttctttttatgtttaagtgattctgtaagcttaaaattcttttcttttttcctttcaggcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaatgtaagttctagttgtacattctgtgggtcatttcttaaagcactaaatgagtgtccaagagtcgtaccaacacagctttgtgcctgtagttcacagtactgtgctgtgtatttagtgtggtctccaccttcttaacaaatgtttcagtgtttttacctcagtaggaagaaaatgtggtaactttaaaacaagcagagcctgtcaccttctgttgtgcttcagtattggtaaatatcagtgctccatagtcagtgttgactcagtgctgatctcagtgcttcagttaattggggctccaaggcactttacattattgccttttattttattttgaaaggtttcaagcctgtggaaaagtttaaaaactagtataatgaacactcatgtttaccttccctttctgtcagcatacctaagaaaaattaataatatttcaacaatatcctataatttgcagccctcaacattatttcaccagttattccaaagatgttttggtaactctccccaccaatctggcccagtgccctgcaagctgcattgcactggggcttgttttgtggctgagcctcagtcaagaacagtcctccattctttttgaagtgtccctgttgttttgcaaatccctcctccatttggatttatctgtttctctccctcccaactagacacaggttagaattattggaaagacactcatgcagtttccctgtgtgcctgcctcttgcatgacccagcctgtctgactgctgctgatgctctgatttcctggggaaagtgctagacgccaaccatctccattagaaacttgcccctttataattactctgtaatctgtctggtacctggagttcctaatggatatcctgtttctcaacagcctttatcccagtgcctttagtacccactggcaagcgttgcctaagtcaactattacgtagatggttgcaaaattgtggatatacctgtccccccatttcttacaaagaacctcttcccactgacctttttattgagtcatagactcagtgggtttttttttttttaatataatccattacctttattcttttgatactcagattttctattgtggtcagtaggagctcaactggctcctgtatccttgacacacagcagtctgagcatcatcttcctttctggttgagatgttccagcctcatctagtactttccctggcccaaacctggttcttgtaatgggcaatggcacttagaagttgtcattgcttttctaccatttcagtggactaagcctggacatttatttgtgttactttctatgtggctttggcctcctaaaccaaccagagctctccctgttttcactcttactctcctgaatctttttctccacaaaggagtcagggttttttgccccaaactctgagatcacatcactcatctgctcacaggccatcattcttaaaatttcaggattggtcctcactctgacttcattcccatcagccacttcaagctcattcctgactcagaccctttgtgcctgctgatccctcctattacggcacctgtcacgtgaaatggtagagcaaaaataggaaatgacattgggtcaacagggcacttggaatgttttgcaaagcacattatctcctgtcattcttacaaccatcatgaagggaatagggtgttggtggtgccagcctagtttaccaaaatgttacaccgtgagtgatgaaaggatcgcactgccatgacttttaaaacaggcttttgctctagttcttacttcagctatccagccatggcgcctgtgattggcatgaattcttctgcatgcattttaatttgttcttattttatagtttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaaggtaagtatttcagcaaaagtggcacactttaagcaacagggaatcactcttcttgggtcacctgtacctgtagctccttgggcttcagtttgattgtagaatctgatgggactggatcccccattagggcttgacctctagctgggccttgtctgttgaggaagttgctctatcaggaaagcagcaccaacagagaaagctaggacttttaggtcccctcgtgcctgacatgcaaaccagatgtgattttggaattctactcccttaggcaggcaagccctgttttttatttctgcttaagctttttagtacagtgagagcgggcatctggggccacagctttctttggcacgtttgttatgttctgtttaccctgtttgtgcctcgggcattgcagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaaccgattccaccgattgctgcatcagcctaaaggtggggagagaagaaatgtcattaggaattaggaaaggtccttaagactaattattcctttttatatataaaaattgactttggcaaaaaaaaaaaaaagtcctggccaggtgcggtgtggctcatgcctgtaatcccagcactttgggaggccgaggagggcggatcacctgaggtcaggagtttgagaccagcctggccaacatggtaaaaccccgtctctacaaaaaatagaaaaattaggtgggcatggtggcacatgcctataatcccagctacccgggaggctgaggcaggagagtcactggaacccaggaggcagaggctgcagtaagccaagatcctgccactgcactccagcctgggcgacagagtgagactccatctcaaaaaaaataaaatcctagaacactcaaatttttttttattttgttttgagacaagctgtcgatcaggctggagccatgcagtggtgcaatcatggttcaccgcagcctccacctcccaagtaactgggaccacaggtgggcaccaccacccccccagattatttattttttgtatttttcagtagagatggggttatgccattttggccaggctggtctcaaacgatccacccaccccagcctcccgaagtgaagtacaggcgtgagccactgtgcccagcccacttcctatggttttttaatcacatgtaagaccttgagggcaacatatttggaaccttatttgctacttagtcaacatggcaaaataaaggatatcactttctcattaaccctaatgagtacagtttcccagaaagtttaaaacaactcagtacaccctcagccattgtgacatgccattttttcccatttgataaaagtgatgaattactaccttttcatgtattttataactagatccagtttttccaaatctttttcttctattagatcagtacagtatttcacaacttggagaatgtcttcttccattggatctaggaagggggaaaaacttcaaatgaggaccagtctttttgaaggagaaagtcagagatctgcatggataaaggaaaactgcatttctacaactatgtcactaacagctatcaaaggaatgggctttgttacttttcaaagcaagtcccagaatttaaaagatttgggggtagctgctttaagcttatcagagttagagaaatgggttaaatctgcatagtttagtctgtttatgttctcaaatcatgagacgactacatctcagccttgggccatctaacacaggccaagccaacctgaaattgtagttatccattctctgagcaaggtcttcacatcattgaattcaacagctccagctagattgggtgctggaggtctcacacagccagctgggtcagactgcaaactagaaaggcctggcacacctgaagtagaagcagagagttcttcctgttaagaaaacaaaggataaaattgctatattcacacattatccaggtatattaagatctcataaaggtcaaagttaaggaattaccaggggtttctctgcaggaggtccttcatgttttagaaacccatcaattaacttctggggactgccacaggcccctggcagagtttttgcaggactgttaagcagcttgttattcaaaggactctgaatcctttttggtgaaccaatggtttttttcttcttgtttcttttcttttctttcactgctgcctttagatgaagtaaaggattctttggcactaagagcagatggatataagatcctcaacaaaatgatagtatggatagtctggatgacagtattgggttctcttttctcctcccaaatacaacaggctccctagcctacacctcccctcctgccccaagtgagaggcagtgaatggcaatggcccaaagtacaggctctccaattctctctttgctttgccacttactaatttgacctttggcatgttgctcatctatgatgggtagtactaaatgtgggtttgatgtttgtgatgcattttgaaccaacatcctttaatgtattcatctcaaaggacaactagctgaacaagtatttaagacatttgtggtaatgtcctattccaactttttaaaaagtaaaaagtggtgtgtttaaatcctgaaagtacagacacaaatccaactagaaatatgatgatatttactcatactgtatacttcagatattatcccaatatgaagagctcttaatgcaacagcttagactttgcccattatatactgcaataattagacaacagtgactccattactctttgtcttcatttttgttacatgccacttccaaggctcaccagatgcgctggctgactgctggtgagtgctgttctcgccctgcctttgtctttgatcatacgctgctttcagctccctctgaagttcagcaggaagggcagcaaatacctcagggtccacctagtggaaaagacgaggtcaaagtcaaacctgagctaattgtagatggtagctggtttctctttttcacaaaacagactttgttttcaaatctcacttttctgatctgtacgaattcttaacagttccccaatatcaaagctgattaaatcttcaaaatggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttctttttgtcgccatgtgactctgcttgctggacagcacagacttgctctacttgttcccggagatcaggtggaagtgcttctaaaacagactgatccagctataaaatgccaaacatatgagtaggaagttaaagcatgctcagagatgaggtgtttgggagttaacacgccactttaaatttcaatttgaatactgtggataatcaatgtaaggtacagaccatcaagctaggaaagccacctccaaatcagcacatttttggaacgtcttggccttttgtcattgaagcctgaagtactatgtgtagtctggaaagaagtgtatatatactaccagccactatcacatgaccaggtaagtccaaatatactcacagaatgtcctgcaattggggccaacagatatgaatagccttggtgaagctcaaattagatcccaccccagggaggggtgaaggcctgaggcacatgttaaaattctggacaggtaacagtcctgggtcaaaagttcacctttcagatgagagactgcccaaaaatacaaataattctactctgagagcagcacactggaagaaagggtttctagaagctgaattttctctaacttacaggacagaatccactgttcctttggccagggcctacctgtgcatccacatctggccctttggaaacatgcaatcccatcaactgggtggaccaatcttatcttgccaggagtaactaattgtgggtatctgtcgccatacaagcatatcagcattgccctttcccctagttttgcagccagtatttaacatctccttccgcctccttccatgcagggggagcagaggcacaaataaacttgcccaatatagcttaaggtgctaccttactttcaaggaccagcagtatatcacatgtacagcccacacacgctgaattaaaccatccaaatctccagagacctgtttgcaaatactgcaaaaacccttcgacataaggcctctacttcaccactaatcaccaaagctgccttgctgaatacagtaagtctgcatgatgaccactgtcacagacaatggcagtccacaggaggactgcctttcagctatgctttacaacttgcaagagtggcaaatctttgcaaaagcactttcactcaacccaaatattgcttatttagaatccaacatcatgatctacccaaacaagtggcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagcagatgatatttccagatccacagcagcccgaaatactacaaaaagaaaatatataaaatagcctcttcagatcatcgggcagggcctttaatcctctgtccattacaaataaaaaaactttattactgattcatcataatgaagaatataaatttttaaaatcacataaagctgtgtcaattttaaaaccaactgccgtctttccaaggacataagcagcacctaaaaaagaaccacattgatgaccaccaaccttctttgtgctcctcttcggtggatttcttagctttctgaacttggaagacatcacggacagagtatgacccactaggaaagtggcttgactgaactgatgggcgactgggacatgtggaagggttcagattagttggaaccaactgattcacgtgaatcccaacctagaacccagaataaagagtatgcttctaggaaaactaaagtgaaaatatgaattcagctaagcaaaatcctcagcaaatccttttcactatctcctggatcctgtttctagaataaaggtaaatgaaagtattcaaacagcattctatatgacttattacaaaaacaatttctaaagtagctagtgagtggtcattcatctcaaacttcagagtatccaattctcccaaaatataccaaaagatctttaaaatcagaaaatccaaacaagtggaatactgtattccactgatgttctcgtcaactaaggttttaaattaggataaaaaaaaattaagagaggacagtctacttggaaacttcactatttttatcttttttaaatgaaatacttctcaaaaaatattggcgggagtgatgaacagcaggtacactgcagacccctccataaagtgccattataacagtatttcagggagaaatcacaattacggctggcttagtgactaatctttcaacaaagcccacatcaagccagaacaaccctttacttacatatgcacacataaaactaaacctacaaaggttctttttttttttttttttttttttttttgagacagagcctcactgtgtcactcaggctggagtgcggtggcacgatcttggctcatgcaagctctgcctcttgggttcaagtgattctcctgcctcagcctcccgagtagctgggactatgaggcatgcaccaccacacccggctaatttttgtatttttagtagagatgggggcaagtgcctgtaatcccagcactttgagaggctgaggtgggtggatcacctgaggtcaggagtttgaaaccagcctggccaacatggtgaaacctcatctctaccaaaaatacaaaaaattagctgggcgtggtagcgggtgcctgtacccccagctactcgggaggctgaagaaggagaattgcttgaacccaggaggcggaagttgcagtgagccgatacaacgccattgcactccagcctgggcaacagggcaaaaactgtctcaaaaaaaaaaaaccccacacaaaaatctatggttttgacattttgatgcctcttgcctgtttcaaaggcatcttgatgtgcctgtggtttcactcccttctaggtcatcatacagcagatgcagagtatgtttctgattaaaaaggaacttaaaggtacaaaatttatgtattcatattcctcacagtcatatctacttctaggaaacaagaacagggaagacatgtatattagcccctggttaatcaggggtaccttggaaaagtacagtaagaatctaagaaaattattctaaaatgaaggaggtcaaaatggaggaagtcaagaatttttgtttctcttttccttgtattacaaagcagctaaagacctacatataaagtccctatacaccagcaataacccttttgagagcaagcctcaaaaatgagagatacattacacaaagtcagaatttacaatgttactatatacttacccctctcatatctgatatatttagtttcattgtatgaaacatgtttagcatcgcctttccaattatttttgcattatctgttgcctggtcaagagttacagtcctgtaagtgatagaattaaaaaacaaaagcttcattccatatgtattcactagtactaaagtagtatggaactgtttaaaagagttatagaaaagttgtaaacagttacaaagaagattataaaagtgaatgccatagtctcccttcaaggaagccagaaataccaaattagttacactggcaaccaagggggaaagaaaaattatggaacactagaactttaaggtaaaaaccgtaatggacacttaggtcaactaaaaataagttgagaaatttagaaaaaggtagattttagctaacatatgcacaaataaatacatattttccagctaaagcacaagtgaatggtaaacacaatgttcttgattccaagagaagttttaggttccaagattatgtatgctgaggtatagcaaatattcagaagagaaagataaattctctgtatgttgtttcttgactctcctttcattgtgtttacagtacagccaataaacaattcttagatctttaagaactcttgaaggaggaccaaatggtccatcagcattattaggtctcaaagatgtgctgacctcacccaccatttccttcagagccttttgagcttctctggcatgagcgggctgtcccattgcaaacagaattactaactcagtaacagattaacaaattactaccagttctctttccaaaggaaagttatttcgtgttttggatgatcctttccatgtataatgaacaaatgaagttccaggccattaaacaagaaatattcccagaaaaaattattataaattgaattggattttcccatagaaatgtttaagaagataatcacattacttcatctgcttatagaaataaccactaaaagctgagcacagtggctcacacctgtaatcccaaaacgctgggaggtcaaggcaaaaggattgttcaaggccagcctgggcaacagagcgagatcctgtctctacataaataagtttttaaagtaaataaataaatgaccactatttactatttgagatacatgtgtatcataacaggtaggtaaatataattcaagataaccaactgataaaaaatgtattttataaattatgttctctaattgtaatttataattcctgctttcatggtaacttgggagtttctctgtttaagagcagtcgtctcacgacttagcaatatcatcatatacatgaatgcaccatgtatggttggcatgagctaatctttaatgaaactatacttcatattgtaagtagctttcagtgtcaaaagtctcaaaattttggtttcacagatgaaatacagtgcaatataaaatgacatgtaaaaccacacatcttcatattggtcacgaatcttacatgaagtttaatattaagtagttggccctgacataaaagacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactacaggcgaatgccaccatgtccggctaatttttgtacttttagtggaaatggagtttcaccatgttggccaggctggtctcaaattcctggcctcaagtgatccagctgcctcagcctcccaaagtgctgggattacaggtatgagccaccacacctggcctgtatcattgtttttaagaactacattgaaattttcctcaggaaaaaagtttcaccaagtcccgaaactatagcagtccctttggtctgcagccttgccctttctttctgtccatgcagtaaagttaacagcccaaagatgccaagcaaaggctgccaaggtcagcaatgccgtcaaaccaacctcctgtgtgtgggcctcgctgaaaccaagtgcattaacctaagctgaatgccttgggctgatgcctgcttctacagaataccagattaacgggtttacaggtctttattcaaactcctccttggttttcttcattttctattacttacaacaacctgtactgaaatataattaccaatatcatttctgaggtgagcttacctggcaatgttatcacaaattccatggcctccaaattttgcagtttctacaggagccccaggctttcgtaccatgattttgagagttagacgtttacccttcatgccagtggcttctagtcttctttgaatttcttctgaaagactcagaagaaaagcttctgcctcttttggctatggaaagacaaacgtggagaaactaccattccactttcctatatacctaataattgttctcaagtattttaactttgaatattaaacatgttggttactcactatcacgctcagc

SEQ ID NO: 14267 - DNA, 181 bp, Homo sapiens
aggttgcagtgagctgagatcatgccactgcattccagcctgggcgacagagggagactccgtctcaaaaaagtaaaactacaacaacaaaaactgtttggtataccctcaactattaaatacaaatacccaccttcccaacaaagtgaaagtaatgagtacttttaaaagatatttttcc

SEQ ID NO: 14268 - DNA, 2293 bp, Homo sapiens
cagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcgtaagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 14269 - DNA, 308 bp, Homo sapiens
tttggccgggtgcagtggctcacgcctgtaatcccagcactttgggaggccgaggcgggcggatcacgaggtcaggagatcaagaccatcctggctaacacagtgaaaccccgtctctactaaaaacacaaaaaattaagccgggcgtggtggcgggtgcctatggtcccaattactcgggaggctgaggcaggagaatggcatgaacccaggaggcggagcttgcagtgagccgagatcgtgccactgcactccagcctgggcgacagagcgagactccgtctcaaaccaaacaaacaaacaaaaaa

SEQ ID NO: 14270 - DNA, 2293 bp, Homo sapiens; identical to SEQ ID NO: 14268

SEQ ID NO: 14271 - DNA, 308 bp, Homo sapiens; identical to SEQ ID NO: 14269

SEQ ID NO: 14272 - DNA, 922 bp, Homo sapiens
ggctgaatggccttttattaaaaatgtaagacattttaaataaaagaagttaaaaagtctgtggaagtattgagggtgagaatctctgctagctagatctctatattaagtgatgagataagctttattaaaaatgagaatcagttcatacttaacctaagcctgacagtgctgggcagagagtcctgctgtaccactaccaatggagccaggcaaggatgcctctctgctagacacagcacatatggacaaagccacaagctatggctcatcccaatagaatcttactagttccctggtaaggttagctataatgtcttctaactcacatcatttgcattaaaaaaagaaagaaacagatgatgactgatacacatgttggttggtagagctttcaggttcctctttccatgtagttgaggaaattcctcagcccattgtcacctcggatctcatgctgcaactccatccttagctcaacacccactggcccctgctttcaaactgttgctggtcttcaggtagagcaggttctgcagatcaaaggacatttttcactaaaaatctctgacatcagagacagagactacatatctataatgaacctttccgaaacctgtccattagaaagccacttctcagtacagaggtggaccttggagactttccaggattttcacatccatctgcgaagaggaaaagaactcctgaaactgggctgacttcataaccagtttaatttcacacatctcacctttctggagctgccttgtttttcccttcttgcatcactgcagagaaaattcatggacttcctaaaggtgagactctgacccattagtaagaaagtcttgctttatgttaagttggctttctctggagatctcctaactgctttataaacattctttcacacctccaa

SEQ ID NO: 14273 - DNA, 98 bp, Homo sapiens
tagtagagatggggtttcaccatgttggccaggctggtctcaaactcctgacctcagatgatccacctgcctcggcctcccaaagtgctgggattaca

SEQ ID NO: 14274 - DNA, 57649 bp, Homo sapiens; identical to SEQ ID NO: 9151

SEQ ID NO: 14275 - DNA, 5541 bp, Homo sapiens; identical to SEQ ID NO: 9152

SEQ ID NO: 14276 - DNA, 296 bp, Homo sapiens; identical to SEQ ID NO: 7601

SEQ ID NO: 14277 - DNA, 101 bp, Homo sapiens
ccagcactttaggaggccgaggcaggtggatcacgaggtcaagagatcgagaccattctggccaacatggtgaaaccccgtttctactaaaaataccaaaa

SEQ ID NO: 14278 - DNA, 126 bp, Homo sapiens
taatcccagcactttgggaggctgaggcaggtggatcatgaggtcaggagttcaagaccagcctggccaacatggtgaaaccctgtctctactaaaaatacaaaaattagccggacatggtggcac

SEQ ID NO: 14279 - DNA, 275 bp, Homo sapiens; identical to SEQ ID NO: 6733

SEQ ID NO: 14280 - DNA, 170 bp, Homo sapiens
aaaagactgggccacgtggctcatgcctgtaatcccagcactttgggaggccgaggtgggtggatcatgaggtcaggagatcgagaccatcctggctaacatggtgaaaccctgtctctactaaaaatacaaaaaattagctgagcttggtggcaggtgcctgtagtctc

SEQ ID NO: 14281 - DNA, 5125 bp, Homo sapiens; identical to SEQ ID NO: 10190

SEQ ID NO: 14282 - DNA, 107 bp, Homo sapiens; identical to SEQ ID NO: 11211

SEQ ID NO: 14283 - DNA, 131 bp, Homo sapiens; identical to SEQ ID NO: 11224

SEQ ID NO: 14284 - DNA, 8432 bp, Homo sapiens
aaaacctgggcacaaaattgggttgactgtgaatcattgtgatgcctgatcactctcctgagacacccaccatcattggtactggttgcctgctcttgacaccggaggccactttgtgtacttagcagttagaaaggtgatgtgtgaggcccggcagctgttggtgttacagctattgtgtgggaaacaaaagccattctgttctgttccccagcctgcctttgtatcacggatagaggagctgtttcataaatgaggtataattctttactggagaatttcattactgcccatgtttcaatgttagcttacacttccaacagcagaggggaatgtctgaacatatctccttttgaaaagaatcttggcttctgacctctgtcaagatgcttgcattttaaatctgttaactagacctgcgattagatgccatcattacaacacatatgcttcccaccttccttgctctagaccacccaacctaaggctggctagagtgtatttgctgtcagcctgcctgtcttggaaattaagcagagtacagtacacactggcacccaggtgaaccagtaggaactagatttctcgcacaattcctcatggatctgtgctaggaaattctcatagagcaaatcagaactgacgtttatttgaagaacatgcactttttcacccaaatggtatatttattattttcatttagaaactatatcaatctaggaagttttcagtagcatataaaaaacaaactggcctaaacaatcaaggaagtgcagtgggctgtgtggttcttcccagccttcatccctccctgggctgtgtcatttgctgtgtgattttgaggttcctccttctaaaggtgagtatatttccctaactcatggatgttaggctcagctacatgacttgctttggccagattttaaaagtattcctattttcacttacctttcacttttctgccattgccgtgagaagaacatgctctggctctcttgcatcaaataagagaaatgtgaggcaggtttggaatctgcaaattggagccagacccacctgagtccaacctagatcagcctacttccagctgacctagaattgcatgagccagaataagtgacagttgttttaagccaatgcattttgaagtggtttcacagccctattgtggcaatatctgactgatatgtattgcttatataactgaagagtccaaaggtagtatgggtttcgggtagggtttgaaaagaattcctgttctatttctgtgtgattctcttggggcttcaacctgggatggtttccctcttggcatgatgaccatagccatttcaggtttcacgtttacaccacgtgccatctagaaaacaagaaggcttctcttcttcaactatcatgcaaaagtcctgggcttcactctgatgaggtcaacttaggtcacatgtgtatcctgacccagtcactgaggaaagagagtgggagtatgccacgtggtttacgtgaatcagagtccctcttgaaaatgggagtgagtccaatctcttccgaaatctgtgttgtgccaaattaaaggtgggagttgtagggtggaacagatgttgagaggtacaagcaatgttaattatggagtctgaatctcccacttttgttttaaatttctatcaatatattgtttggctcaagccattttccttcctccatgttgctaggctatctagagacagagaaatgggatttaagctctagatctgagatgttacctttaaatggcaaagcgcatggccacacccatacccctacagtactggaaagtgggtgggaacccaaataagactttaccattattctgtcagacttccaactcctggtatcccagggttttaagaaaatccaaagcaggtttgacctatcagaatgcggagatttctgatgtagaggatgaagttaatgctgatgtaattaacagcatgggatgaggtgataagaatatctttccactgacttctggtcaccattgtttccaatgagaagtcagctgtaatctttgtcactgtccagacacatagtaagcaccaaaaaatgtgtgttgaatcaatggattaaaaatagaaccaagatcttttggcacatatcccaatgttcttccaagactactctatcacttctttgtaaaactttactttgcacatttaatgtaccccttgcagcttctgcagggaagtaaatgaaatcaatgactaattcaggtaatttttgtaaacatggacattaacatgatcaccagttactttctgtgcttctgagaggcctcctgactctgaagtatctgaaaggttgaacaaccctaataattgaatgcatttttgccatttaataaatgtttgccattttacaaatattattgagcatctactgtccacaagacaccgcgttaagtaacgtgagggacagagaattgaacatgagctaaaacttgtcttcaagtacccaactaatataatttgtcactcaaggtttcagggaaactgtggacagaagaaaagacttgggacctttcatggaactacagattctcagggagtagcttgcctgtctccttgtagtgttacttactagttgtctctaatcattaaggatctcagttctgtatgaaacatctgtcagcattaagacaacatcttgaaaaccagcattttgatgtgacctagctgggatgtcaggcatatccacatgttcttacattaatttcttaaaaacatcttcccatgcattttatggtggctgtacatgggcactattaggtttgttttggtggtaatgtcctggttagataattctacatagttgcaaatttgagggtatgaacactgctacgttttctttgactccttctttgtcttcgtattttttttccagatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaacaccatcagagaacagacctgagattgtttggtactccacacaccctgcctatgtggatggatgaatcagtagaagaatattctagatcaggggttagcaaactatagccctgaggccaggcctggcttgccaactgcttttgtaaataaagctttattggaacacagccacactcatttatgtgttgtctgtggccatttttgtgctacaatagcagattagatggcagactcctctgctgagtagttggaacagagaccatatggccttcagtgcctaaaatatgtacagtctcacccttcccagaaacagcctactgaccccttttctaaaggaatgttttccttactggcccgatcacaaaaaccacctgcagcatttgttaaagatgtagattccaagatcctgcacccaacttacagaatctggactcctggggaatggtctaggaatctgtatgtcaatagacactccacataatcaggcaggtttggcaatgagttttgacttcatacattacaaatacactttcagaaatggcatgtgggccaggacctttcttccagcccttgaattttggatcccctggaacaggtaaaacccttcagggaatatggaggcctgtgcatctcttctgatgctgttttctcatccccctcaaagcactaaacaaggtttcctttcagagcccatttttctgatgggtgatgctcagggatttccagcatccccagtctctctctccatgtgctcacttgagcacctctttaatagaaaacaccctggattagggtctgagagctcgggatcatggcctggcatcatcagcacctaacatggagccctcagtgtattgtctagcttctctcaaactcgctatcttcatttattttttaaaaagtttcatagatgttttaaaaccctgactttgggaaccacagaaccctgaattaagagtccagtttttccaaatcttttgctcaggatcacatgaaaaactttagctaccattcaaaactacaggtgctgagaggtaagcaggagatgggaaaatgcagcctaccatcactcttctggaagccagcagagttcttagctcaggacaggtggggccttgtgaagggctgggtaagcaaatggatggaggaaatgaccctcaaaaggtgtatgtgcctggttaacgtggagacgagctaatcccaagtggttattttgctcatttaacatcacattaaccagataaaaaaagaattgattttttcactttctagccagtttgttcagttctccagaacatactcttaggtaactagaaataaattatgagtcattactgaagttagtaacagagttcatgtgctttgaataatgtggtcagtctgcagcaatatttcactgcaagcatgaaatgatgagaagcacctaggaatattccattcccagggtatgccacgttatagtctgagtgctttacttgttctgatgggtctcttcctcgaaaacttttgaacagcaagttttatgcaaccattttcgaatgatgaattattaaggtggagctgtgaaattatagcagttaagaagttataaacaggtcttaaatcttaattcagctatatacttagtcataatgttttatttaaatgattacattgagacatatacaagtaattttctttttgtggagtcaacttagatctaataaagacaagtataaattttgatgtaagtattgggtcgattaaatttcccaatcaaacagagctttttaaagcattctaaaatactcataattctctatcatcattacacagattacgtacactaaaaatagactggtatcagtttacagatctctaatccttaagagaggaaatagttttctcattattttctctaattattttaagtcagcaatcaccatggtaacctactgcgtattttactttcccagtttaactgccatttgaacttaattttatacatgatttgagctgaaatgaagaaatacagttttcacccaacactgaccaccaatgaggattgaatctacattttggaagcaaaatttaggagaatcagcctccttgtagtcttttttggtttgtttttgtttttgttttgagacagagtctcactctgttgcccaggctggagtgtatggagcaatctcggttcactacaacctccgcctccccccaggttcaagcgattctcttgcctcagcctcccaagtagctggtactacaggtgcaagccaccatgcccgactcatttttgtattttcagtagagattgggtttcaccatgttggccgggctggtctcgaactcctggcctcaagtgacctgcccgccttggcctcccaaagtgctaggattacgggcaggggccacagcgccctgctgcctccttgtagtcttgagctgcattgtcagactcagcaggggcatcatcattcctggaaaatccactcgaggctcaggacagtaacctctttctccagaaaatctggtaattctgtcatctgacaacaaaacaaacacaactttgttcttgtattatttccatgcaagaaattataaaacacatttggtctcctcttcaaaggacaccaaaagcagtttgtgtaaattcctatcctttcttccccaagtgctgaggtgctactgggagagctgaagtgctttgcccaaactcactccctgatattccctaggatgtaagctccatgtgatgaggcaatactgtggtggtgttctgactttttatttttttaagtatgctattttatctgctagctgtgtgcagttaatctgcacagacacatctccttgtctgtggttgtcaggcctgagtcctgcgtcttgtccttcctaggaggagcctgttgggccctccagcaccgggagacatgcatggcaggcattttcctggggtgtcccaggatcccagtcttttacttcccctgctgtcctccgtgccctcctgctcctggccctggtgatccccagcagagccgaggagccagtggccctgctctcagaggcttctacagtctccctcagccctgcgggagacctccaggggtggagatgggcaggggcgtagcgtcatccagggtggggtgggctcagctaattggttccctccccccttgtctggtgcacttggcctctgaggggagcccaggaggaaaggacccagccttctttcctgtcacctgcccagccagcgcaggagcatgcgtgtttgtggcaaggatcaggagctgggcagggcaaggctagggctgtggggtggtgctcttgcattgcagggcattgaggaagaaaacaccagcttgtactatggggtagagggccgtgaattggaggggaaagaacagatcttaagactgtgtgttcttcataatgcccaagacatttaagtgatagatttggattatttttaaatgactgttcttgtgattggtgggttgtgttcatttggccaccccgttctttgggactgaaagttcctggctcggacactatgatgtcacatgtgcattttccttctcggtgcttccattaataagactatttaaaacctccaaccactggagaaagcagaaagagcttggcctcagccgttagcccacctctgctgccaagcagtgttgcagccctgagggaggaactgtcctcatctgtgctgaaggagagtcccagcaggggcccccaggtcctgccagcctgaaggcgccaccacggtagaaactccacaaaccctctcagggtgagatctgtaaagtgaactcactataaagtgaactcccaccaagtctagcattgctgaactcctcaactgcagtgctttgactctttcaggtttccacaaagatattccagaatcctttttttttaattatataaatgctatagcaaaatagaaaaaaaaaagaagaagaagaagaagagaaggagccggaaccaggtgtatgcacctctcttctgtttctgcatcctttcactcctggtgtggcgcgtggaccagcagcattgatatcacctgtgagttcgttagaaatgcacaacctcaggccctgccccagtgtcccaaacaggtttttttccagaattatgcagaacagcatcttgactgtctcctgggcctgcgttcatagagctgaggcagttgctgtccccttctgtttcagcacgagtctctatgcttcagtgttttatagtatttactcctaattatgggaaagttcctttttaatccattatttttaactctttcctaatttaatcccgacgtaaagaatcttttgaagagcctgtaatggcactagaaaaatgcttactggagtcatggatgacagtgactgaaagcagcccagctggtgtccccgcgaccctccgtgtgactagagagaaacactgattcataggaagcaccggtgggcactggaaagcccgggttccccttgtcttccacttccaccactcagaagagttttctcgaaaactgaccaaatcatccagcaaaagatgcagcctcagactttcagcctagacactgatcccctcatctggttgaatgtgtcgaggtaactaagaatagcttggaccaagcagggcatgtttctaaagctgcaattgtggcaatgaccacaactcctgttatcgggccgtgcagttccgcacaatatccggcacagctgtgggctctggcagcagccagcctagcgctggcggcttaattaggctttttatctttacatttgtctgaggacatctgaaaccttcagtgtggcctgtcactaattaggtgactaattaaatagtcagtgcttccttgctgatctcagagctcaaccgcaatggacaggtttgtgattgtgactccccgtcctgtcggtctctgcacgtgtgcgcctcgcaattgccctgttcattgcgctgtgcaaaaacggcatgggagcgaggcccagggcatgtgcagggccgtcctccgatgtgcccaagcagcaggcagcacggacatccacaggggggcatatgggagatggacatccacagggcatacgggacatcagttctggtgcagaggctggtctggtggccagagcagaggggacggtggaaggagctttacctgccaggctcagagtctcagtctccccaggcagcaagagttgacattctgccaccagagaataaggatccagaactcaccctggtgtcactaatcacaatggggtttcctattcgactccaatatttaaatgtaattaatgttaaataaaagcaccttcatttactgaaa

SEQ ID NO: 14285 - DNA, 8432 bp, Homo sapiens; identical to SEQ ID NO: 14284

SEQ ID NO: 14286 - DNA, 3471 bp, Homo sapiens
gctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatagtaggagcgcgcggggcggacgcgggagtgtgtgggtgtggtggccaagggtggagtgggggcgcggtgccggagaccggttcgttcgggcgcggtctccagtcctctttttgccctcagcattggggagaatcttcaactgctggtggaccggcccgatggcacctactgtttccgtctgcacaacgaccgggtgtactatgtgaggtgaggcggggccgggcaggcagcatggacccaggggagaggggtcctgggtcccacgagcctccttcatccgcaaccttgctccccctttacccttttagtgagaagattatgaagctggccgccaatatttccggggacaagctggtgtcgctggggacctgctttggaaaattcactaaaacccacaagtttcggttgcacgtcacagctctggattaccttgcaccttatgccaaggtttgtggggcggtttccaattctgccacgggcgatgaagtcaaggattaggcagattgtccggcagcttctctcccacagagtccctgacagtgtgcttggaggagtttcagcacatggagatgtgtagaggtcttgcagcttgagcatggtcagggctatgggataggaatgctatgtggctgcgtagggttagttttctccagcgaagtagaagagcctagggagacccagctagagatcagaaagcaaataagtggcagcaatgaagacaccggggtccagaaaaagagctgttaacctggccatggaggatgatccttgtagagttgagaaaataactttttctatttttttctttttctttcttgctctgttttttcttttcatttctctttctctttcttcctgacacagtttcactctgtcgcccaggctagagtgccgtggtgcgctctcactgcagcctccactttccagtttccagtgattcttgtgcctcagtagctgggattacaggcatgtgccaccacacctggctgatttttttgtgtgtttttagtagagacagtgtttcactgtgttggccaggctggtctcgaactcctggcctcaagtgatccacctgccttggcctcccaaagtgctgggattacaagcgtgagccactgcaccgggcaacttcctgcatttctgttcaggagatagacagtttgaggaaaacatgagtctctctgtttcccttaaaattatttcagaaaattattcacagatccagcagctagcttgtctgcatggatagaaatagtaacgtttttatgtctcttggattttaattctcttatagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttggtgagtagagatggtagctgttacagaactcaagtactcttattcaagaagggtatgtcttcaatctgagtgcttgagagaataaattctcagcacgttttgaatcccagaaagaccagaactgtattttttccgtctttgttatttccagccctcaatatgggcatattgaatgacttcagtgagttagtgtctcttcttttgaatcccagggttttggggtggcagcgcaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaagcaaacttga

SEQ ID NO: 14287 - DNA, 3470 bp, Homo sapiens
gctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatagtaggagcgcgcggggcggacgcgggagtgtgtgggtgtggtggccaagggtggagtgggggcgcggtgccggagaccggttcgttcgggcgcggtctccagtcctctttttgccctcagcattggggagaatcttcaactgctggtggaccggcccgatggcacctactgtttccgtctgcacaacgaccgggtgtactatgtgaggtgaggcggggccgggcaggcagcatggacccaggggagaggggtcctgggtcccacgagcctccttcatccgcaaccttgctccccctttacccttttagtgagaagattatgaagctggccgccaatatttccggggacaagctggtgtcgctggggacctgctttggaaaattcactaaaacccacaagtttcggttgcacgtcacagctctggattaccttgcaccttatgccaaggtttgtggggcggtttccaattctgccacgggcgatgaagtcaaggattaggcagattgtccggcagcttctctcccacagagtccctgacagtgtgcttggaggagtttcagcacatggagatgtgtagaggtcttgcagcttgagcatggtcagggctatgggataggaatgctatgtggctgcgtagggttagttttctccagcgaagtagaagagcctagggagacccagctagagatcagaaagcaaataagtggcagcaatgaagacaccggggtccagaaaaagagctgttaacctggccatggaggatgatccttgtagagttgagaaaataactttttctatttttttctttttctttcttgctctgttttttcttttcatttctctttctctttcttcctgacacagtttcactctgtcgcccaggctagagtgcagtggtgcgatctcactgcagcctccactttccagtttccagtgattcttgtgcctcagtagctgggattacaggcatgtgccaccacacctggctgatttttttgtgtgtttttagtagagacagtgtttcactgtgttggccaggctggtctcgaactcctggcctcaagtgatccacctgccttggcctcccaaagtgctgggattacaagcgtgagccactgcaccgggcaacttcctgcatttctgttcaggagatagacagtttgaggaaaacatgagtctctctgtttcccttaaaattatttcagaaaattattcacagatccagcagctagcttgtctgcatggatagaaatagtaacgtttttatgtctcttggattttaattctcttatagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttggtgagtagagatggtagctgttacagaactcaagtactcttattcaagaagggtatgtcttcaatctgagtgcttgagagaataaattctcagcacgttttgaatcccagaaagaccagaactgtattttttccgtctttgttatttccagccctcaatatgggcatattgaatgacttcagtgagttagtgtctcttcttttgaatcccagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaagcaaacttga

SEQ ID NO: 14288 - DNA, 3470 bp, Homo sapiens; identical to SEQ ID NO: 14287

SEQ ID NO: 14289 - DNA, 564 bp, Homo sapiens
aaaaagataaaaaaggaataacagtacctatctcgaaggctgttgtgaggtttaaatggattaataaagcgctcagcagagaacctggaacgtggtaaacgctttatgtgttagttatttctaccatcgtaaatgtcagcttttacagttataaaacccctttagcgccaggcgcgtcgcacctgcagctctgctggaagctgggcaaacggtcgagcaggcggccgagcgacgcctccacgtcgccaaacaggcggtggatgcgctcggtgcactcggcgccgcggatgaaggtcttgtagttagcgaaggccaagtcgcgcgtctgctgcagcagctgcgcccgctcctccgccaggcgctcgggctcgcgccgcagccgctccagccccgagccgctcaactcccggaggtagcggcccacatcgggccgctcgcgccactgggcctcggggaagcggtcccggaacagcgacgccaggagcccttcatcctccacctcgccgagagccgctgctgtggccgtggctaccgatgggatagtcgccgcggtcgccatcttcc

SEQ ID NO: 14290 - DNA, 4600 bp, Homo sapiens
gaactttttcactgttatgattttattgccattttgcttttttagatgtgtgcagcagactaaaacattaatgagataattgatttttgtcccataacattacaaagctgattcgactaagccccagaagaaaacagccagggtgctatagtcaccttagcttagcatcttggcttctttgtatctgtagttgttggaacattgaagagacgcttcaagaaatacagttgcaggatcccagaaagaataataacaaggctctgggctgtcgaccaccagttcacgtagttatagtttgattggataaggaaaaagtcagccattttcctcatccgggcaaagttgtagtatcgccacatgtgaaagatattgttctgcaccttttgtgtgccgtcctatgagagggacaattttaagggggattcttccaaacccccatctagcctcacctgagcgctcactagcactaacctatctcaagtcaaataatttacccatatgattttaagatgtacaatacaatgatagttgttaaatgttgtgtttgctatgtatgaaatatggtctggatttgagtttaaaatttttgtttttgttttatgagacagggtctcacttgtttgcccaggcaggagtacagtggcgcagtcacagctcactgcagcctcaaccttctgcgctcaagtgatcttcccacctcagcctccctagtagctgggactacaggcacatgccactacacccagctaatttttttttttttttattgtagagacagggttttgccatgttgcccaggctcatctcgaactactgggctcaagagatccacccacactggcctcccaaagtgttgggattatggtcatgagccactgccccggccttttgttttgtttttaaataatggaaaacttcagtactcaaactagagagctcttccagaggacctctagatttagatgtactcagcatgtcgttaccattccaggtgatgttttatgttctctgtatatggtagaagacaagggcctgtggactttttattaaaaggccagatggtaaatatttttggctttgcaggcccctgtgactgctgaactcttgccattgtagtacaaaagcagccacagacaatatgtaattgtcaaatgagcatggctgtgtttcaagaaaacttccatttacaaaaacaggcagtgagcttttgtgcatttaggagagactattaagaaagtgaaaagtggccgggtgcagtggctcatacctgtaatcccagcactttgggaggccgagacgggcggattacctgagatcaggagtttaagatcagcctggccaacatggtgaaacaccgtctctactaaaaatacaaaaattagccaggtgtggtggcacacgcctgtaatcccagctactcgggaggctgaggcaggagaactgcttgagcccgggaggcagaggttgcagggagctgagatcgtgccactgtactccagcctggccgacagcacaagactttgtctcaacaaaaaaaaaagaaaaaaagaaagtgaaaagtggccgggcacggtggctcgttcctgtaatcttagcactttgggaggccaaggtgggcagatcacctgaagtcaggagttcaagaccagcctggccaacatagtgataccccatctctactaaaaatacaaaaattagccaggcgtggtggcacccgcctgtaatcccagctacttgggagactgaagcataagaatcacttgaacccgggaggcggaggttgcagtgagccaaaattgtgccactgcattccagcctaggtgacaaagcgagactctgtctcaaaaaaatataaataaataaataaataaaaatacaaaagttagctgggcattgtggcacacgcctgtagtcccagctactcaggaggccgaggcaggagaatcgcttgaacctaggaggcaaaggttgcagtgagccaagatcacgccactgcactccagcctgggagacagaatgaaactccgtctcaaaaaagaaaaaagaaagtgaaaagacattgccagaatgggagaaaatatctgcaactcacatatcttaggagggatttgtatccagaatatataaacaaaattcaacaataaaaagacaattcaggcagggtgcggtggctcacgcctgtattcccagcactttgagaggctgagctggacagatcacaaggtcaggagttcaagaccagcctgaccaacatggtgaaacccccgtctctactaaaaatacaaaatgtaggtgggcgtggtggcacgtggctgtaatgccacctactcaggaggctgaggcaggtgaatcacttgaacccaggaggcaaaggttgcagtgagccgagatcacaccactgcactccagcctggacgacagactgactctctcaaaaaaaaaaaaaaaaaaaaaaaaaaaagtaaaatgggcaaaggattttcatttttatgagatagggtctcactgtcacagccttgacatcctgggttcaagcaattctacctaagcctcccgagtggctgggaccacaagtatgtgccaccacacccgggtcatttaaaaagttgttttgtttgtagagacagggtcttaccatgtttcccaggctagtctcaaactcctgggctcaagctatcctacctcagcctcacaaagtgctgggattacaggtgttgggccaactggcctggcctaaaatgggcaaaggactcgaacagacatttctccaaagaagagagatggccaatacgcacgtgaaaagatgctcaacattattaatcattagggaaatgcaactcaaaaccacaagataacatttcacacccactaggatgactgtaacaaaaaataagtgttgatgaggaagtagagaaattagaaccttcatacactgctagcaagagtttaaaatggtttagccactgtggtaaacagtctccagtaattccactttcaggtatacacagatgaaaacatgctaacacaaaaacttgcatgcaaatgtccatagccacgttatgatagccaagaggtggaaaaacctaaatatccatcatgtccattaactgatgaatggataaataaaatgtgtatccataaaagagagtattattcagccataaaaagaaaagtactgatacatgctacaacatggatgaacgttgagaacatgctaaattaaagaagccagtcttggctgggcgcggtggctcatacctgtaatcccagcactttgggaggccgaggcgggccaatcacctgaggtcaggaatttgagaccagcttggccaacatggtgaaaccctgtctctactaaaaatgcaaaaattagccgggcatggtgagaggtgcctgtaatcccagctacttgggaggaggagaatcacttgaaccctggaggcagaggttgcagtgagctgaggttgcgccattgcactccagcctggacaacgagcaaaactccgtctcaaaaaataataaaaataagccagtcacaaaatcccatgtactgtgtgattccatttaaataaagtgtatagaggccagccacagtggctcaaagtgctgattaatctcggcacagtagctcataatgctgagtaatctcagctcagtggctcaaagtgctgaatctgagcactttggcaagccgaggtgggaggattgcttgagcgcaggaggttgaggctgcagtgagctgtgatcaagccactgcacactgcagcctggacaagagtgagaccctgtctcaaaaattaagtatagaataggtaaatctatagagacagtagaacagtgataggcaggcctggggtaatagaatggagaatgactaatggggagtgggattttgagggtggggtgggtgataaacttccagaattagatgctgatagttgcacagccttgtgaatatactaaaaaaccactgacttacacacttttagatggtgtacggtgtatgaattatatctcaatttaaagaaaaacaggcaatgggccagatttggcctgtcagccatacatagtttgccaacccttggtataaaacgaagatggaatttcaagagcttcaagtcgtaatttattttgagacggtgtcttgctgtatcccagactggagtgtagtggcgtgatctcggcttactgcaacctctgcctcccagggttcaagcgattctcctgcctcagccttccgagtagctgggattacaggtgcgcaccaccacgcccagctaatttttgtatttttagtagagacagggtttcaccatgttggaaaggctggtttcgaactcctgacctcaggtgatccacccacctcggcctcccaaagtgctgggattacaggcgtgagccaccgtgcccagccaagtcataatttatgaagaaattcacatccccttgcctgtttggtttctacctaaatgaagtcatcttccctctgaagttaaaaatcagtttccacagatgtttctcttccacaaaacacttccttacctcaattgcatccagagtatcattcagttgttttctttccttctgtttgtgatcagtc

SEQ ID NO: 14291 - DNA, 8523 bp, Homo sapiens
gaactttttcactgttatgattttattgccattttgcttttttagatgtgtgcagcagactaaaacattaatgagataattgatttttgtcccataacattacaaagctgattcgactaagccccagaagaaaacagccagggtgctatagtcaccttagcttagcatcttggcttctttgtatctgtagttgttggaacattgaagagacgcttcaagaaatacagttgcaggatcccagaaagaataataacaaggctctgggctgtcgaccaccagttcacgtagttatagtttgattggataaggaaaaagtcagccattttcctcatccgggcaaagttgtagtatcgccacatgtgaaagatattgttctgcaccttttgtgtgccgtcctatgagagagacaattttaagggggattcttccaaacccccatctagcctcacctgagcgctcactagcactaacctatctcaagtcaaataatttacccatatgattttaagatgtacaatacaatgatagttgttaaatgttgtgtttgctatgtatgaaatatggtctggatttgagtttaaaatttttgtttttgttttatgagacagggtctcacttgtttgcccaggcaggagtacagtggcgcagtcacagctcactgcagcctcaaccttctgcgctcaagtgatcttcccacctcagcctccctagtagctgggactacaggcacatgccactacacccagctaatttttttttttttttattgtagagacagggttttgccatgttgcccaggctcatctcgaactactgggctcaagagatccacccacactggcctcccaaagtgttgggattatggtcatgagccactgccccggccttttgttttgtttttaaataatggaaaacttcagtactcaaactagagagctcttccagaggacctctagatttagatgtactcagcatgtcgttaccattccaggtgatgttttatgttctctgtatatggtagaagacaagggcctgtggactttttattaaaaggccagatggtaaatatttttggctttgcaggcccctgtgactgctgaactcttgccattgtagtacaaaagcagccacagacaatatgtaattgtcaaatgagcatggctgtgtttcaagaaaacttccatttacaaaaacaggcagtgagcttttgtgcatttaggagagactattaagaaagtgaaaagtggccgggtgcagtggctcatacctgtaatcccagcactttgggaggccgagacgggcggattacctgagatcaggagtttaagatcagcctggccaacatggtgaaacaccgtctctactaaaaatacaaaaattagccaggtgtggtggcacacgcctgtaatcccagctactcgggaggctgaggcaggagaactgcttgagcccgggaggcagaggttgcagggagctgagatcgtgccactgtactccagcctggccgacagcacaagactttgtctcaacaaaaaaaaaagaaaaaaagaaagtgaaaagtggccgggcacggtggctcgttcctgtaatcttagcactttgggaggccaaggtgggcagatcacctgaagtcaggagttcaagaccagcctggccaacatagtgataccccatctctactaaaaatacaaaaattagccaggcgtggtggcacccgcctgtaatcccagctacttgggagactgaagcataagaatcacttgaacccgggaggcggaggttgcagtgagccaaaattgtgccactgcattccagcctaggtgacaaagcgagactctgtctcaaaaaaatataaataaataaataaataaaaatacaaaagttagctgggcattgtggcacacgcctgtagtcccagctactcaggaggccgaggcaggagaatcgcttgaacctaggaggcaaaggttgcagtgagccaagatcacgccactgcactccagcctgggagacagaatgaaactccgtctcaaaaaagaaaaaagaaagtgaaaagacattgccagaatgggagaaaatatctgcaactcacatatcttaggagggatttgtatccagaatatataaacaaaattcaacaataaaaagacaattcaggcagggtgcggtggctcacgcctgtattcccagcactttgagaggctgagctggacagatcacaaggtcaggagttcaagaccagcctgaccaacatggtgaaacccccgtctctactaaaaatacaaaatgtaggtgggcgtggtggcacgtggctgtaatgccacctactcaggaggctgaggcaggtgaatcacttgaacccaggaggcaaaggttgcagtgagccgagatcacaccactgcactccagcctggacgacagactgactctctcaaaaaaaaaaaaaaaaaaaaaaaaaaaagtaaaatgggcaaaggattttcatttttttgagatagggtctcactgtcacagccttgacatcctgggttcaagcaattctacctaagcctcccgagtggctgggaccacaagtatgtgccaccacacccgggtcatttaaaaagttgttttgtttgtagagacagggtcttaccatgtttcccaggctagtctcaaactcctgggctcaagctatcctacctcagcctcacaaagtgctgggattacaggtgttgggccaactggcctggcctaaaatgggcaaaggactcgaacagacatttctccaaagaagagagatggccaatacgcacgtgaaaagatgctcaacattattaatcattagggaaatgcaactcaaaaccacaagataacatttcacacccactaggatgactgtaacaaaaaataagtgttgatgaggaagtagagaaattagaaccttcatacactgctagcaagagtttaaaatggtttagccactgtggtaaacagtctccagtaattccactttcaggtatacacagatgaaaacatgctaacacaaaaacttgcatgcaaatgtccatagccacgttatgatagccaagaggtggaaaaacctaaatatccatcatgtccattaactgatgaatggataaataaaatgtgtatccataaaagagagtattattcagccataaaaagaaaagtactgatacatgctacaacatggatgaacgttgagaacatgctaaattaaagaagccagtcttggctgggcgcggtggctcatacctgtaatcccagcactttgggaggccgaggcgggccaatcacctgaggtcaggaatttgagaccagcttggccaacatggtgaaaccctgtctctactaaaaatgcaaaaattagccgggcatggtgagaggtgcctgtaatcccagctacttgggaggaggagaatcacttgaaccctggaggcagaggttgcagtgagctgaggttgcgccattgcactccagcctggacaacgagcaaaactccgtctcaaaaaataataaaaataagccagtcacaaaatcccatgtactgtgtgattccatttaaataaagtgtatagaggccagccacagtggctcaaagtgctgattaatctcggcacagtagctcataatgctgagtaatctcagctcagtggctcaaagtgctgaatctgagcactttggcaagccgaggtgggaggattgcttgagcgcaggaggttgaggctgcagtgagctgtgatcaagccactgcacactgcagcctggacaagagtgagaccctgtctcaaaaattaagtatagaataggtaaatctatagagacagtagaacagtgataggcaggcctggggtaatagaatggagaatgactaatggggagtgggattttgagggtggggtgggtgataaacttccagaattagatgctgatagttgcacagccttgtgaatatactaaaaaaccactgacttacacacttttagatggtgtacggtgtatgaattatatctcaatttaaagaaaaacaggcaatgggccagatttggcctgtcagccatacatagtttgccaacccttggtataaaacgaagatggaatttcaagagcttcaagtcgtaatttattttgagacggtgtcttgctgtatcccagactggagtgtagtggcgtgatctcggcttactgcaacctctgcctcccagggttcaagcgattctcctgcctcagccttccgagtagctgggattacaggtgcgcaccaccacgcccagctaatttttgtatttttagtagagacagggtttcaccatgttggaaaggctggtttcgaactcctgacctcaggtgatccacccacctcggcctcccaaagtgctgggattacaggcgtgagccaccgtgcccagccaagtcataatttatgaagaaattcacatccccttgcctgtttggtttctacctaaatgaagtcatcttccctctgaagttaaaaatcagtttccacagatgtttctcttccacaaaacacttccttacctcaattgcatccagagtatcattcagttgttttctttccttctgtttgtgatcagtctcaggcccctcatagaagaccccaaagttgaggtacacttgcacagaaccgaagtgattatgctgattacttagacaaagctgataaaaacctgtaggaattcttagatcattaccaagtctttggtctcctcccctttgttaaggattccctggaggtatctgtcctctagttttggaattctactacaggaccttctttttacttagaaagtacaaagatcccgtttttgacatggaagacacggaccttatgttaaacttatactaaatattacttattatatttggccaaattttagtaactcgttctttccatactgggtagtggcaaacaatgttttctctttaacatataattcccacatcttgtattaaggaactcctgctcaacagattgagttgaagttaagagcatggtgtttgcctggtccttgtatacaattaaagctagggacaccatcttgaacttgaaattaggaaagacaaaaaaaaaaaatagatgcatagtgcatgaaagcagctctcctggagtgattgcctccaaggcggtgtgtacagtgactcatggtttggttatatctgttggggctggggttgcctccctttgtgtgtgcgggggggaggggggcgcggggtggggagcgggtgggaaggagcaaggtggagaggaccggtagaagatgggtggggtgggattagaaaggtgtggcagtgtttgaaagtcaaaatgattggaaggcactactggcatgtaggggccaaagatgttcaagatcttttttttttttagacgagtctcgctctgttgcccagaccggagtgcaatggcgcgctctcggcccactgcagtctctgcctccaggttcaagcaattctcttgcctcagcctcccaggtagctgggattacaggcgcctgccaccacacccagctaatttttgtatttttagtagagacggggtttcaccatattggtcaggctggtcgcaaactcctgacctcaggtgatccgcccaccttggcctcccaaagtgctgagattacaggtgtgagccaccacgcccagcctgttcaagatcttttaacactgatacacatgctgtgcttcatagtgaaggactgtctgatgcccctgttgagaaaatgtcttttttagtgcagctggctattaaagagggcagttaagacactgctgctctccaaagtgggacaggcttgacctggctggaggagtgctttgctgtggagtgtggatatctcacatggatatcatgcattttcttttgttctgaatctgcttttagtaactgactcaaatattctgatgactggaaagacatgcttccctgtaatccatttgttaattggaattctgtattataaatgggtctctgttttttggtcactttcccagaatctgattaactggagatgatgagataaaattgagcggctgaaccctagacttagaatgctcacctggagtgttgcccccaaatcgtcagtagactgccacttggcatccttggaggtcagcagcctccaggaacactggtttttggtgttaaaggctgaatttttttcctactgttaaaacatctctgtatacttcctcattatttctgtaatttcataggaccctatgattattataatagccatggtaatgaaaacagacctgtctcttgggtagagaagttaatctggccccgaacaccctgggaggtgtctatgagaaatccctgtgggttatgtgccgtggcagcaacatgccggtcatgtgacatccccactgtccgctgaacctgccaagacacattaaataggtagcagaacccctgctacatcacgaggaagccagctgagtggtaagattgacgtcccacggtcatcagcacagcggtctctgtctggggtgggactgcccaaccccctgctggggtttggagttgattggaggattctgaggtatcacagtgatggtgttaaggggaggcagcacagcattgctgaacgtctgcaatgtaagaaacagtacagcaggacaaagaactgcccagaatgccaacagcacccgtgtgaagaagacatgccttgctcggaacacacagctagtgtggatccactaaaatgtatgattctgggccgggcgcggtggctcacgcctgtaatcccagcactttgggaggccgaggtgggcagattacaaggtcaggagttcgagaccagcctggctaacatggtgaaaccctgtctctacttaaaaaatacaaaaattagcctggcatggtggcgtgcgcctataatcccagctactttggaggctgaggcaggagaattgcttgaacccgggaggcaggattgcagtgactcgagatcatgccactgcactccagcctgagcgacagagcaacactctgtcaaaaaaaaaaaaaaaaaagtacgattctggctgtagaattttttattttttttgagacggagtcttgctctgtcacccaggctggagtgcagtgatcttggctcactgcaacctccacctcccaggttcaagcgattctcctgcctcagccacccaagtagctgggattacaggcacatgccaccaagcccggctaatttttgtatttttagtagagatgcgttttcaccatattggccaaggtggtctcgaactcctgacctcaggtgatccgcctgcctcagcctcccaaagtgctgggatgacagatgtgagccaccgcacccggcctggctgtagagttcttgaatgaacttgcttggtggttgagctccccaatgatgtcccagatttgggcatttgctgcttggcagtgcacacctacaacaagcactccatggacacttgctcccaagctagatcttgattaggccaggccacagtgagcttagtagtggctgctgttctaatagaaattcagaggtaagaaaagtctctgataagtttatttaaaataaatgttgttacagtggagtaagatcaacaaagtctattactatgtaaacaaaaattagaaagttaaccgatttctaagataaagaacaaaggaaatgaacagcctctaactttcatactgagttcaccatccttggacagcatgatataagaccatagtatgggtaaaagtacttgacctttgaataagtaacttgaaaacacttaccgtcctaaaaaaaaaaaataggattaactggccgaatacaaaaaacttgacctagtgaatctctgacttgccagaattgctcctaaaggcagcagaacctttactcccccaccccataagctgaagcagccttctttgaaatctctggatcagtctccaaagcaccattatccaattttgttttaatatattaaaaatgtattctctcccctctcatccccaaatccgagtacatgtaatgattacctcttcagggagaggcaccccgtctgccccatggctttgagcatggcccctgatgtaagaagccaaaccatatgttttagctcctgttggtgattattcacccagctggagtttccctctaactgcaggtccatttcattaacaggtggggaatcacagcataataaagacaaccagaccttgttttggcctaaaacctgacccactttatgagtaaaggagaaaaaaaaaagccccccagtatggccagtcacccacatacctcgtaactgaaatagaagtatccagtctggtgggcaaattgccaaaagcattccgtgcctcctggaggtatcatgatggcaaagtcatatcgatcagctccacggaagagtggctggtccccagagccacttagaggttctgtcttctggctcctggcagacgtcactagattcagaacgaccagcccagccccaaagagcaaaggggacatgccgctttctggagcc

SEQ ID NO: 14292 - DNA, 6960 bp, Homo sapiens
attctaaaattggattcatatttactaaaaaacactgacttacacaaatggatgaattatttagtatgtgaattacacatcagtaaggcagtttacagaattttcattctcttacctaaagtctgtgctatctgagctggtggaaaaaggacttggagacagcgatttaaatacggaacaaggtcttccaggaagacagtgcagaactggacaaagagctcttgctccccgctgctgaaggcagcctcttcagcgcgatggaaggccaggattattttagttacctaagagacaagggcaccgtcaattactgggacagcctatcaccactgggacagcagtgcatgaaactaggcaaaaaaatgtatgcccctccagttttcctgaacaaagtaatttaacagtacattattttactgtctcatttaaactcagaattatggtcattgtccacaattgtgtcactttattaatgtgaagttcagacccaacttgttacattacgggtatagtttccggttccagtggaggagtgtcataaaactatagagagaatacatggttttggtttttttttttttttttttagagacaggattttgctctgtcacctaagctggagtgtagcggcacaatcagctcactgtagcttcaaactcctgggctcaagggatactcccaccttagcctcccaagtagctgggactacaggcgtgcaccatcacgtctggctaagttttaaaattttttgtagagacagggtcttgctttgttgcccaggctggtctggagcccctggcttcaagagatcctcctacctcagcctcccaaagtgttggcattacaggcgtgagccactgcgcccggcccaatacatggttcttaacttccacggaggaccaaccagaactgtgctggatccaggaaaatgaagcaaaactatacaagctttctactaagccccgaggtttcagaaagctagaaccactggaaaactgtaagaaaacagctaggaaagagaagtttcaaaaccaacagagcagcctagctgacactacagatatgtggcatagcgacagggtaagaacacagactctgatgctggacttcccaagttcaagtgactcacacctgtaatcccacactttgagggtctgtagcaggaggatcacttgagtccaggagtttgagaccagcctaggcaacatagggagacactatctctctgtaaaataaaacacttttaacaataaaaataaaagaatatgctaaaggtaaagggttttgtagatgtaattaaagtccctaatcatctgacttaatcaaatgaagtttttaaaaggaggtacctaaaagaagagactcaagagagtagctctcctgctggccttgaggaagcaaacagccatgttgtcagctgcctatggagtggacagcctctaggagctgaggcttcagttctgcaattgcaaagaactgacccctgccaacttgcatgagtctgaaatggagccccaacctccagatgaggccatagtccagccaacaccttgatggcaaccctgtaagaccctgagcagagaggacccggttgtgctgtgcctggactcctgacccaccaaaactggaaggtaataaatgtgttgctggaagctactaagtttgtggaaatttgttatgcagcactagaaagctaatacgtgtattaccgaattgttactataggcaaatcacttcatggactgtcctaggtcccatgaagggcaactggccagagcttctcaatcaggagaacctccaaaaccacactagacctctccatgtcagcagacaccgtcaaatagacgggtttattacaaaaatctggccacccattaccagagaaggcccagggtagcagaaaaccaacagaatgtgctcaccttggcaagggcatcttccaaggccccagtcacatcctgcgccagggccacagggcagcagaggcgcagatcattgaaggcaaccagaatattgttgagaaagcaggcgaggggtgggaaatctaggagcaccatgggtggctgcagcgtccccggctgggtggctggcacagcagcaggcatgttactggtgcccaggatggctggagccgagatgagcatgtaggagttcatttcttcctggaatttctccacggtgttcctgaattgctttctggaaagtgctgatggccacccgctggaaaacaggagccaactgaccccggaaatcagctcccacccggctgaaggacagcccaaagtacatgcactggcccagcagagagtccaggtggccgcctatgccccggtaaaggtcggtctccagcacctgcaggaattgtgagaccttctgtagcacccagccatggaagatggcactctcattcacagtgtgctcacccatggcagggggcagcagtgggtcctcgtctgagaagatggcacggtactgggtgatgatatcaaagagatggacacgggaggcctcgatggtttttgtaatatggaaatagggatcatcattaggaatggcagtcaggatggaccggagccaagcatctcgggcctgaagaaacttcaccctcaactcagcctcagtgaagacgtccatgcgccgcaggtagccaatgacacggaggcaggcaggaagctggatgttggtcctcagttgctggatcagctggctcagcatcagctgcatggactggcgcacttcgttcacgatgccctgacaatacacagagagagtcacactgcgctgggaaggatgctctctagaacccattcccctaactctgaagactgcagaccaacattcccatggctttcctgaaatgtgaagtaatttcctaaagctgatgcctgtaggttcaccaacaaagatcaggttagttaactctcttgcttaaaaagcttaaaacctggccaggtgcagtggctcaaacctgtaatcccagcaccgtgggcaggcaggtcacttgaggtcaggagtttgagaccaatctggccaacatgtgaaacctcgtctctactaaaaatataaaaatcaggtgggtgtggtggtgcaggcctgtaatcccggttactcgggaggcagaggcaggagaatcacttgaacccgggagataaaggttgcagtgagccaaggtcgcaccactgcactccagcctgggggacagagcgagactctgtctcaaaaaaaaaaaagaaaaaaaaaaaagcttaaaatcctccagtgacttcccactgcaatcaagaaaattccaaccacttgttgggacttacactggtggccctacctggctctccatcttcacctgcttcctagtgctctcccgctgctacaatccattaaccctggctgcctctgtatcccttaaacacctcaatttctgcccacttcagccctctctacttgttcttcacactttctggtttgctctctccccagatctttgtgggctggcacctccttctcatttaggtctcagcttaaatgttacctccctagaagagtccttcttgatcaccctacctaaagaaacctaccctagactcccttaccccattccctgtttttttcttcagacaccactatctgaaatgatatcatttctttgtcaattatcagacttcccattagcacgtaagctgcatgagagccaggaccactttattcacactgtatccccagcatatagagcagtgcttggcacatgattaatatgtattttgaataaatgaatgttttctgttcaggcatacctggctggcagaaactgatgtgaaacatgcaagagtttctacctaaagcttcagtcctgaccacagaataaatgattacaagaacattactttgagtcctctctgggcaaggtggctacctggatgacagggatggaagagtatttcctctccagtcggcgtacgtaggctgcaagctccagggcctcttcataataactgttccggacacaggtgtccatgagctgaggaatctccagtatttccaaaatttctgtgtgccggtttagggtcaggctattcatccggcggttggagctgatctcctcggcttccttcacaaagttcctagtaataatcagaagaatgttgatccttcactgctctgtacccaaaccttagctacagttaccaagtacctgctatgaacattgggctggatgatctatctgatttattcctcacaccccacctataaggtaagtattattacaattgaggaaatttttaatcccagagaggttaagcaacttgtccaaaaacatacaattaataaatctaacagatggagatccagatatgccacttgctggctgtggcaaggtacttggcctctctgaacctatttcctcattagtaaaacggtatatagggccaggcgcagtggctcacgcctgtaatcccagcactttgggaggctgaggtgggcggatcacttgaggccaggagttcaagtgaaaccccatctctactaaaaatacaaaaaattagccaggcatggtggtgcgcgcctgtagtcccagctactcaggaggctgaggcaggagaatcacttgaacccaggaggtggaggttgcggtgagcagagatggcgccactgcactgcagcctggccaacaaagcaagactccgtctcaaaaaaaaaaaaaaaaaaagtatataggaccctcctcataagggtgtaagaactaaatgagatgatgtgtgtgaagcatttaacatagaacttgaaacagagcgaatgcgtcaaagtaaaaatagtaaaagagacacagttaaatatttaacagtagctatcattattttcaaaatgaagcactaactgcctagaatccacaatctttcccctcaggtcttcatcttctcctatgctaatgttcaaccatagttcctgccacagtctactttcaacacttctccatatttgcagagacctgctttatcaagtcccctatctattctggagcatggaagggtacaaaagctgctgtcaaatatccaaaggctcaaaagaaaaattaaactttaatcatgaaaggctggaaggcagaactagggataatggagacagaatatgactcacaaaggacttttttttttttttttgagacggagtcttgctctgtcaccaggctggagtgcagtggcacgcatcatcttggctcactgcaacctccgcttctcaggttcaagtaattctcctgcctcagcctcccgagtagctgggactacaagcgcgtgccaccacgcccagctaattgtatttttagtagacatgggggtttcagcatgttagccaggatggcctcgatctcttgacctcgtgatccgcctgccttggcctctcaaagtgctgggattacaggtgtgagccaccgcacccagcctttttttctttttttaagagagtttcactttgtcacccagtctggaatgcagtggcacaatcacagcccaccgcagcctcgacctcccaaactggagtgcggtggcacaatcatggctcactgcagcctcaatctcccgggcccaactgacccccccacctcaacctcctgtgtacctgggactacaggcgcacgccaccacgaccagctaattttttattttatagagacagggttttgccatgttggccaggctgctctcgaactcctgggttcaagcctcaggctcccaaagtgctgggattacaggctgagccaccacatccagccatccaaatggagagactttttgatatctgatgccctcaaatgcgaggatttccttgtcaccttcccgtcaatggaagttttgaagcagatgacctccggtccacgctttcgtataaaataagtatataaatgtgcacatatattcagctcacacctataatgttaactgtgtcagacccgataataagagctttgcatgaatcctttttctttgtgcccacaactgcccttcgagggagggacgtgcttctgggtaaccagttctgaattcgaaacctcctagctgtgtccttggacgtcactaatctctgtcttgacttgctcatatgtaaaatggaaataacagggctgggcgcagtggattatgcctgtaatcccagcgctttgggaggccgaggcggacagatcacgacatcaaaagatcgagaccatcccagccaacatgctgaaaccccgtctctactaaaaatccaaaaaaattagctgggcgtggtggcgcgcgcctatggtccctgctactcaggaggctgaggcaggagaatcgcttgaacccaggaggcagaggtaggttgcagcgagccgagatctcgccactgcactccagcctggcgacagggcgagactccgtctcaaaaaagataaaaaaggaataacagtacctatctcgaaggctgttgtgaggtttaaatggattaataaagcgctcagcagagaacctggaacgtggtaaacgctttatgtgttagttatttctaccatcgtaaatgtcagcttttacagttataaaacccctttagcgccaggcgcgtcgcacctgcagctctgctggaagctgggcaaacggtcgagcaggcggccgagcgacgcctccacgtcgccaaacaggcggtggatgcgctcggtgcactcggcgccgcggatgaaggtcttgtagttagcgaaggccaagtcgcgcgtctgctgcagcagctgcgcccgctcctccgccaggcgctcgggctcgcgccgcagccgctccagccccgagccgctcaactcccggaggtagcggcccacatcgggccgctcgcgccactgggcctcggggaagcggtcccggaacagcgacgccaggagcccttcatcctccacctcgccgagagccgctgctgtggccgtggctaccgatgggatagtcgccgcggtcgccatcttcc

SEQ ID NO: 14293 - DNA, 10940 bp, Homo sapiens
gccagtcacatgcttacctgcatttttaaagacagctttcaggtatttggggactacattattaccaaaccttggctttgggagattatacaggtccgaggaactcgtgtctactgcagacgaatgcaattaccccaccttcctccatacagaattgttaggaaatgtccactcctttgggggtgatttttctcctcaagttgtagccaacattttgtccgtaactgatttcagggcaaacatttctgacatcttcctccagctcagtctgccatgccttggcaatccagtttcctgtcatatgcgagccatccaagttgatgccaagtaagatttgcccagctcaaagtgaaagtgtttgcgtcttggtatccggaatcctcagccccagtagcaaagctttagtcattcaccttcatccaatagacgtttgtgaacgtcctgctgtccattttgtcaataaacaggcagccctgcaggtggtccatctcgtgctggatgatgcgggctgcccacccgctcgcctgccacaccacctgttctccattggggtccagccctgcaaaggaagttacagccctggtgagtgggaacagctgaactgcatcatcctcaacctccctacccctgcccccggtcctggctgttcccattgacaagaggcaacagcagatggcaaatgtagacagcagctcctcttctaactggaaaacgtccctcatctcggtccattaccaagcgttcaacctggttcccaactctggtaattaggttatcgagctcactgtagagctgagatgagaaatcatctttctacggtgcgacccttccgaacactcctcccacttctgaggtacctgtgggctcccaactcctaacagaggttctgcagcttgagaccccacttgtttttctgaccatcttgaaccgacgggcttgctgtgcaggaacaatcaccccgaccccagcagagcccgcattccgcgaggcatcctgtggtaccacgggggaatggcctagccccctgggctgggtcaggctggcgggggctaacccccacttctccaactccaccgtggcggatctaactggggccgaagagcgtgtttgcctcagagagcaagggagcagaaagcagacgccaggctgtcaggtaacagcggaactaggggacctctcctcgcccctgcgtcctatctgagcgggctctaccccacaggagcttctatccgtcctgaggcctctccgctcccgcatcccacttcgctcctgcgggaggtccggcgtatgaaccgcgaccacttctgcgctctcgcggagtcgggcagaagagacgcgcgcgctgctccagcagccccggtccccgccgcccgcacctgagatctgcaccgcctggaagcggggcacgcaggccaggaagccggcgacgctctcgcagccctcgggaaaggtgaccaggcggctgtcaagcactcgcaggctggggttcacgaacacgcgcagggggaagggctccatttggcggagcgcgcgctggcggggcgggcactcccgacacagcgcctcggggagctccagcgccagcacctgccgcggcacccccagctgcggcgcgcttaggcccacgcagcgccgccgccgcatcacctggaccagccgttgcgtcagccgctgcagctcgggcccgcctagctgcgcccgctccaccggggccgccacgccgcgcagcaccgggtccccgacttggcacacgtgcgagaacggcggttcgggaggacccagcaccagacgcctcaggtggcgccaataggagcgccgcagcgccgggccctcgacgccgtccggggcggccgtggagctgcaagcccggacaccgacggctgccgccccgccccacggcacggccgcccacagtggccaaagactcagcgcgccccacagccgggccatggcggcccccttaacagtgacccggcccgccccttccggccgcagcgcggggcacgccgggaagcgccgtcggccagcacacagcgaagccgcgactggatccccgccttcctgcttagactggcagtgagcaccgcccccttccgctctcctcccgggagcgccttcccgcctcccgaacccgccccggaccttccagggcgaggcagtcctggccaccccgcgccgggaacctcacgcaccgcgttctggaggcaggggacgccggctagggccccacgctgggcggttcggcctgcgtctccgctcgccctccctccgggcaggctgggcccgcgggctccaggcgtggctcctcggcgggaggctctggtgctggagctgtgagctcgggccccagcgcctggtcatccagggtgaaaagcgtctctctctttggcaggataaaggcgaggggctcctgaatggcgccgatgttcacatgccctaggttaccgtacttggagagctgagtgggaggaatgcctaacccagacgtggggaaagcaaaatggaaaacagttactaataaaactcaatatagaaattttaagggaggcgggcgcggtggctcacgcctgtaatcccagcactttgggaggccggggaggggggggcggatcacctgaggtcaggaattcgagaccagcctgacccacacggagaaatcccatctctcttaaaaatacaacattagccgggctttggtggcgcaggcctgtaatcccagctacttgggaaggctaaggcaggagaatcgcttgaacctaggaggtggagattgcagttagccgagatcgcgccattgcactccagcctgggccacaagagcaaaactccgtctcaaaaaaaaaaaaaaaaaaaaaaaaggaaatttaagggaaaaaaaacgagccattactatttttttttttgagacagtctcgctctgtcgccccaggctggagtgcagtggcgtgattgctgctcactgcaacctctgcctcccaggttcaaacagttctcatgcctcagcctccgtggtagctgggattacaggcgccccggccaccatgccaggctaatttttgtatttttagtagagacggagttactatgttggccaggctggtctcaaactcccaacctcaggtgatccatccgcctcggcctcccaaagtgctgggattacaggcatgagccactgcgcccagccatcaattactatgttttaatacagcaaaaaccacctttgttacagggaatgggaagctatactgtgaagcagaacgtaacggaacagcagtgtagggtgcctgcagcaggaacccagacctcaggcagcaccagggaaaaagcagagggcagccaggctttgcacgtgtgatgcactgacccattgccctttgggaagctgtgcctcaaccaagcccctctcctaccacaaagggacaaggacgtgaaagtgaattggaaaaaagactttaggacgggcgtggtggctcacgcctgtatccgagcactttgggaggccgaggtgggcggatcacaggtcaagagatagagaccatcctggccaacatggtgaaaccccgtctctactaaaacacaaaaattagctgggcgtggtggtgcgagtctgtagtcccagctactcgggaggctgaggcaggagaattgcttgaacccgggaggtggaggttgcagtgagccaagactgtgccactgcactccagcctggcaacacagcgagactccgcctcaaaaaaaaaaaagactgtaaaaaccatttctctagatatttcacataaatggaatcatacgtatgtagttcttttgtgactggcttcttccgcttagccagatacagccacataatgtatgattccatttttatgaaatgtccagaagaggcaaatctatggcaacagaaagtaggttgccagggactaaggatgctgtcgaggaatgactacaaacgtgcatgaaggatctttttggagtgatggaaatattctaaaattggattcatatttactaaaaaacactgacttacacaaatggatgaattatttagtatgtgaattacacatcagtaaggcagtttacagaattttcattctcttacctaaagtctgtgctatctgagctggtggaaaaaggacttggagacagcgatttaaatacggaacaaggtcttccaggaagacagtgcagaactggacaaagagctcttgctccccgctgctgaaggcagcctcttcagcgcgatggaaggccaggattattttagttacctaagagacaagggcaccgtcaattactgggacagcctatcaccactgggacagcagtgcatgaaactaggcaaaaaaatgtatgcccctccagttttcctgaacaaagtaatttaacagtacattattttactgtctcatttaaactcagaattatggtcattgtccacaattgtgtcactttattaatgtgaagttcagacccaacttgttacattacgggtatagtttccggttccagtggaggagtgtcataaaactatagagagaatacatggttttggtttttttttttttttttttagagacaggattttgctctgtcacctaagctggagtgtagcggcacaatcagctcactgtagcttcaaactcctgggctcaagggatactcccaccttagcctcccaagtagctgggactacaggcgtgcaccatcacgtctggctaagttttaaaattttttgtagagacagggtcttgctttgttgcccaggctggtctggagcccctggcttcaagagatcctcctacctcagcctcccaaagtgttggcattacaggcgtgagccactgcgcccggcccaatacatggttcttaacttccacggaggaccaaccagaactgtgctggatccaggaaaatgaagcaaaactatacaagctttctactaagccccgaggtttcagaaagctagaaccactggaaaactgtaagaaaacagctaggaaagagaagtttcaaaaccaacagagcagcctagctgacactacagatatgtggcatagcgacagggtaagaacacagactctgatgctggacttcccaagttcaagtgactcacacctgtaatcccacactttgagggtctgtagcaggaggatcacttgagtccaggagtttgagaccagcctaggcaacatagggagacactatctctctgtaaaataaaacacttttaacaataaaaataaaagaatatgctaaaggtaaagggttttgtagatgtaattaaagtccctaatcatctgacttaatcaaatgaagtttttaaaaggaggtacctaaaagaagagactcaagagagtagctctcctgctggccttgaggaagcaaacagccatgttgtcagctgcctatggagtggacagcctctaggagctgaggcttcagttctgcaattgcaaagaactgacccctgccaacttgcatgagtctgaaatggagccccaacctccagatgaggccatagtccagccaacaccttgatggcaaccctgtaagaccctgagcagagaggacccggttgtgctgtgcctggactcctgacccaccaaaactggaaggtaataaatgtgttgctggaagctactaagtttgtggaaatttgttatgcagcactagaaagctaatacgtgtattaccgaattgttactataggcaaatcacttcatggactgtcctaggtcccatgaagggcaactggccagagcttctcaatcaggagaacctccaaaaccacactagacctctccatgtcagcagacaccgtcaaatagacgggtttattacaaaaatctggccacccattaccagagaaggcccagggtagcagaaaaccaacagaatgtgctcaccttggcaagggcatcttccaaggccccagtcacatcctgcgccagggccacagggcagcagaggcgcagatcattgaaggcaaccagaatattgttgagaaagcaggcgaggggtgggaaatctaggagcaccatgggtggctgcagcgtccccggctgggtggctggcacagcagcaggcatgttactggtgcccaggatggctggagccgagatgagcatgtaggagttcatttcttcctggaatttctccactgtttcctgaattgctttctggaaagtgctgatggccacccgctggaaaacaggagccaactgaccccggaaatcagctcccacccggctgaaggacagcccaaagtacatgcactggcccagcagagagtccaggtggccgcctatgccccggtaaaggtcggtctccagcacctgcaggaattgtgagaccttctgtagcacccagccatggaagatggcactctcattcacagtgtgctcacccatggcagggggcagcagtgggtcctcgtctgagaagatggcacggtactgggtgatgatatcaaagagatggacacgggaggcctcgatggtttttgtaatatggaaatagggatcatcattaggaatggcagtcaggatggaccggagccaagcatctcgggcctgaagaaacttcaccctcaactcagcctcagtgaagacgtccatgcgccgcaggtagccaatgacacggaggcaggcaggaagctggatgttggtcctcagttgctggatcagctggctcagcatcagctgcatggactggcgcacttcgttcacgatgccctgacaatacacagagagagtcacactgcgctgggaaggatgctctctagaacccattcccctaactctgaagactgcagaccaacattcccatggctttcctgaaatgtgaagtaatttcctaaagctgatgcctgtaggttcaccaacaaagatcaggttagttaactctcttgcttaaaaagcttaaaacctggccaggtgcagtggctcaaacctgtaatcccagcaccgtgggcaggcaggtcacttgaggtcaggagtttgagaccaatctggccaacatgtgaaacctcgtctctactaaaaatataaaaatcaggtgggtgtggtggtgcaggcctgtaatcccggttactcgggaggcagaggcaggagaatcacttgaacccgggagataaaggttgcagtgagccaaggtcgcaccactgcactccagcctgggggacagagcgagactctgtctcaaaaaaaaaaaagaaaaaaaaaaaagcttaaaatcctccagtgacttcccactgcaatcaagaaaattccaaccacttgttgggacttacactggtggccctacctggctctccatcttcacctgcttcctagtgctctcccgctgctacaatccattaaccctggctgcctctgtatcccttaaacacctcaatttctgcccacttcagccctctctacttgttcttcacactttctggtttgctctctccccagatctttgtgggctggcacctccttctcatttaggtctcagcttaaatgttacctccctagaagagtccttcttgatcaccctacctaaagaaacctaccctagactcccttaccccattccctgtttttttcttcagacaccactatctgaaatgatatcatttctttgtcaattatcagacttcccattagcacgtaagctgcatgagagccaggaccactttattcacactgtatccccagcatatagagcagtgcttggcacatgattaatatgtattttgaataaatgaatgttttctgttcaggcatacctggctggcagaaactgatgtgaaacatgcaagagtttctacctaaagcttcagtcctgaccacagaataaatgattacaagaacattactttgagtcctctctgggcaaggtggctacctggatgacagggatggaagagtatttcctctccagtcggcgtacgtaggctgcaagctccagggcctcttcataataactgttccggacacaggtgtccatgagctgaggaatctccagtatttccaaaatttctgtgtgccggtttagggtcaggctattcatccggcggttggagctgatctcctcggcttccttcacaaagttcctagtaataatcagaagaatgttgatccttcactgctctgtacccaaaccttagctacagttaccaagtacctgctatgaacattgggctggatgatctatctgatttattcctcacaccccacctataaggtaagtattattacaattgaggaaatttttaatcccagagaggttaagcaacttgtccaaaaacatacaattaataaatctaacagatggagatccagatatgccacttgctggctgtggcaaggtacttggcctctctgaacctatttcctcattagtaaaacggtatatagggccaggcgcagtggctcacgcctgtaatcccagcactttgggaggctgaggtgggcggatcacttgaggccaggagttcaagtgaaaccccatctctactaaaaatacaaaaaattagccaggcatggtggtgcgcgcctgtagtcccagctactcaggaggctgaggcaggagaatcacttgaacccaggaggtggaggttgcggtgagcagagatggcgccactgcactgcagcctggccaacaaagcaagactccgtctcaaaaaaaaaaaaaaaaaaagtatataggaccctcctcataagggtgtaagaactaaatgagatgatgtgtgtgaagcatttaacatagaacttgaaacagagcgaatgcgtcaaagtaaaaatagtaaaagagacacagttaaatatttaacagtagctatcattattttcaaaatgaagcactaactgcctagaatccacaatctttcccctcaggtcttcatcttctcctatgctaatgttcaaccatagttcctgccacagtctactttcaacacttctccatatttgcagagacctgctttatcaagtcccctatctattctggagcatggaagggtacaaaagctgctgtcaaatatccaaaggctcaaaagaaaaattaaactttaatcatgaaaggctggaaggcagaactagggataatggagacagaatatgactcacaaaggacttttttttttttttttgagacggagtcttgctctgtcaccaggctggagtgcagtggcacgcatcatcttggctcactgcaacctccgcttctcaggttcaagtaattctcctgcctcagcctcccgagtagctgggactacaagcgcgtgccaccacgcccagctaattgtatttttagtagacatgggggtttcagcatgttagccaggatggcctcgatctcttgacctcgtgatccgcctgccttggcctctcaaagtgctgggattacaggtgtgagccaccgcacccagcctttttttctttttttaagagagtttcactttgtcacccagtctggaatgcagtggcacaatcacagcccaccgcagcctcgacctcccaaactggagtgcggtggcacaatcatggctcactgcagcctcaatctcccgggcccaactgacccccccacctcaacctcctgtgtacctgggactacaggcgcacgccaccacgaccagctaattttttattttatagagacagggttttgccatgttggccaggctgctctcgaactcctgggttcaagcctcaggctcccaaagtgctgggattacaggctgagccaccacatccagccatccaaatggagagactttttgatatctgatgccctcaaatgcgaggatttccttgtcaccttcccgtcaatggaagttttgaagcagatgacctccggtccacgctttcgtataaaataagtatataaatgtgcacatatattcagctcacacctataatgttaactgtgtcagacccgataataagagctttgcatgaatcctttttctttgtgcccacaactgcccttcgagggagggacgtgcttctgggtaaccagttctgaattcgaaacctcctagctgtgtccttggacgtcactaatctctgtcttgacttgctcatatgtaaaatggaaataacagggctgggcgcagtggattatgcctgtaatcccagcgctttgggaggccgaggcggacagatcacgacatcaaaagatcgagaccatcccagccaacatgctgaaaccccgtctctactaaaaatccaaaaaaattagctgggcgtggtggcgcgcgcctatggtccctgctactcaggaggctgaggcaggagaatcgcttgaacccaggaggcagaggtaggttgcagcgagccgagatctcgccactgcactccagcctggcgacagggcgagactccgtctcaaaaaagataaaaaaggaataacagtacctatctcgaaggctgttgtgaggtttaaatggattaataaagcgctcagcagagaacctggaacgtggtaaacgctttatgtgttagttatttctaccatcgtaaatgtcagcttttacagttataaaacccctttagcgccaggcgcgtcgcacctgcagctctgctggaagctgggcaaacggtcgagcaggcggccgagcgacgcctccacgtcgccaaacaggcggtggatgcgctcggtgcactcggcgccgcggatgaaggtcttgtagttagcgaaggccaagtcgcgcgtctgctgcagcagctgcgcccgctcctccgccaggcgctcgggctcgcgccgcagccgctccagccccgagccgctcaactcccggaggtagcggcccacatcgggccgctcgcgccactgggcctcggggaagcggtcccggaacagcgacgccaggagcccttcatcctccacctcgccgagagccgctgctgtggccgtggctaccgatgggatagtcgccgcggtcgccatcttcc

SEQ ID NO: 14294 - DNA, 397 bp, Homo sapiens
gaactttttcactgttatgattttattgccattttgcttttttagatgtgtgcagcagactaaaacattaatgagataattgatttttgtcccataacattacaaagctgattcgactaagccccagaagaaaacagccagggtgctatagtcaccttagcttagcatcttggcttctttgtatctgtagttgttggaacattgaagagacgcttcaagaaatacagttgcaggatcccagaaagaataataacaaggctctgggctgtcgaccaccagttcacgtagttatagtttgattggataaggaaaaagtcagccattttcctcatccgggcaaagttgtagtatcgccacatgtgaaagatattgttctgcaccttttgtgtgccgtcct

SEQ ID NO: 14295 - DNA, 3738 bp, Homo sapiens
gaagtgagaggtgacaacgtgctggcagccctcgctcactctcagcgccttctctgcctcggcgtccggtctggccatgcttgaggagcccttcagccctccactgcgctgtgggggcccctctctgggctggccgaggccggagccggctccctctgcttgcagggaggtgtggagggagaggccaggcgggaactggggctgcgcacagcgatggcaggccagcatgtgttccgagtgggagtgggctcagtggcactcggagcagctggccagcgtggctgggccctggcagtgaggggcttagcacccgggccagcagctgcggagggggcgccgggtaccccagcactgccggcctgcctgccccacgctcgaattctcgcagcgcctcagccgcctccccgccgggcagggctagggacctgcagcccgccttgcctgagtccacccgcggtgggctcccagcggccaagcctccctgacgagagccgcccctgctccgcagcaccaggtcccattgaccacccaaggactgaggagtgcaggcgctcggcacaggacttggcaggcagctccatccgctatctcaagggaaaaaaaattaaatagccaaatccccaaacaagttaattttagctaggattaaggaggtcctctctgctttaatctttacaaggaaagcaactgaaaagaacaatccacattctgttctctgtttctgctttccccagcccttattctttctataaagccaacctcctctgcttagctctatggaacactcattctattttaaagaatgaggtgttgtccgattataaatcacaaaagctaattaagatgtttaactaaatttgatataattttttttttgtcttttgacagcccttcctctgacgtgcacaggatatgaaaatgtctgatagtgttgtggctgcagtgagacctgggagtggcagtttctttcactgcagttgtctgtccaaagcgaagtgaactagcaagtctcttacaaaagggcaagctctgaactgcgcacagtgtgagcacagacacagtggggctaatctacaggggcagtgttagcagcaatgggttgtccaagatttctgagaggattagcacctagaaaataatcttattttgctttgtggtgtcagacaaaggaactgaatgagaaaattattgaagggcatattgtagctgatatgcagatccaaggctgactttcttcctctcccttgaatccacttatcacaaaaatatggaatgagcagaacttatgggcataaccataaaccaattttcctttgtttcctactgtctctttaaagttttctcagtgggagaaatcttctgtgtccttggatgaagacttactcagtaaattactttatgatcactgataggtaataaaagatcctatggtcatttaaaaataaaccatagaattttaattcagaaattattatcctagttccatataataatctagactccaaacttgatttaaaggtaaattttctctaccttcctaagttagagcttcctgcagtctttcccttctatctctcctcctgcctactaacctgttttctgacctgttacattttatttgccctgataaattgggtgaacagggtgattactaagcagctgcttcaacttgtcagaggacagttgaccagcctgggtctcaccctttgtattccctgtcatacctcaatccactttgtttctcccattgtagatggtacttatgctattggagtccccctgacgttctctctcttgacttgagatgaagggaatacaccttatacattgcacctctacttccatcccactagcagctttctacaaataagtcttgtctaaataagtttcctctgatgccccacaacccaattcttttttattctcaaggtcaatgaggggtatagtgaaacctgacacataactggtttttggttattttcttggaaaatttttcatttttgtttaacacctcacttgagtacctggctaatcaaaatgtgggcccgggatgggcagcattggcatcacctgggagcttgttagaaaagctcaggccccagcccagacctacaaaatcaaaatctgcattttagggagctctccaggtgattcgcatgcacattacattttgagaagccctgcttttgaagtcctttcaactgtttcttggtgtctcaatcttcctatttactttcctgttacacatttagagtccaatgtcctaatgtagctttgtgggttctattttcagaaaggaggagtgccagtgtctgtcctttgcaattgcagatctcaaactatttataaacctattaataacttaaatgtctttttactgaattcaaatgttctattgtcacatcaagttcagtatatcctacgtcaaatccagcattttcccccaaatccgacacctattctaactccttttacccattctttgatatctaataatggacagtcttctccaagactatttccttgaccactgaagcacagggtgatcactcaactcttgtaccgtgccagcctttagcacttatgacagcctcttttttatttatgtttatactggcttgaactaacatttaatttttcattcattcagcatttcttgggcactttctatgttccaaccaatgtttaaacagctgttaaagaacaaaacaaattagtcttctgtcctcttgaaagttacattttcagggggagaaagatacaaaaaatagataaatatgtaatttcataccacaatgacggctttcaaattgataatgtcaggctcaacctctccttttaattgtaattcatgtaaccagtgtctgctcaatatctttacttaaatatctagtatgcacctcaaacttactgtatccaaaaccgaattcttgattttcacttcaacaccctcttttcctaatgctctccatctcaatgtacaacatcaccatctccacaaaaatcctctttctttcataccccacttttaatccatcagaaaatccctataattctactttcaaaacatacccaaattattgctacttctctccacttcctctgcaacagctctgtggaggtctccaatgtctcctctggactgctataccagccacctgacagccatcctgcctccctcatccctctactacagtacgtactctaccagtactctgagccatctttcacagagttagtttgagcattccctagctcaaaactctcccattgcttcctgttgcactgagaattaaatctaaagacttcacagagtccctcaaggccctacagactcttggtccccatgctgcccctctgactcacctcctccctaccactcttgccttcctttctcatccccgtcactttggcccacttgatgttctttgaacacacacatctggctatctccccaagtctttgcaattgcttaaaccactcttcccagatacccagaagacttgctttctcattttcttaaattatctctgtattcaaatatcaccccctcaagaggtctatcctgactttctctctcaccttctccttttctttatgatatttagccataattcgccccccatacacatgcatttgtttattcatctgttggtttattgtctgtctcctcactaaaatgtaattactccaaaatgtaatttccacaatagcaataaatttatctttttattttaa

SEQ ID NO: 14296 - DNA, 309 bp, Homo sapiens
tttgtgttttttttgtttttgttttttgagacggagtctcgctctgttgcccaggctggagtgcagtggcgcgatttcagctcactgcaacctccacctcctgggttcaagcgattctcctacctcagcctcccgagtagctgggactacaagtgcccaccaccactcccggctaatttctttttgtatttttaggagaggcggggtttcaccgtgttagccaggatggtctcgatctcctgacctcgtgatccacccgcctcggcctcccaaagtgctgggattacaggcgtgagccacggtgcctgg

SEQ ID NO: 14297 - DNA, 1361 bp, Homo sapiens
ccgtcggactgcggccgcccttggctcaactgggtcgccgaccttgttgaggggcgaccactgcggggagaccgagagcctgcggctggcgtttgaggcggatggcagtgccctgagcgcggcggctgggtctcggtgacactgacgacgggaggcgcggtcggaagagcgcggggccgtcgcctctggcttaacatagcagatgcgctgagactccaacaggtggctccgtggcgcaatggatagcgcattggacttctagaggctgaaggcattcaaaggttccgggttcgagtcccggcggagtcgtaacgcttttttccctcccccctacaatttattttctgcctccatcatgtctcttattttttttttttgctaaacggtttaacttctctctcattccctgctctcgcagttcactgcattcggttcttgcggtcctttcttaagcggctcgcagggtcccgagcccctcagctccccgggcctcggtggcccagggcccagctcagccgactgggcagtcgatgtaggtcctgagaagagcggcggcggcggcggcggcggcggcgaaggaaaagcgacactgaagcgaaggctcgcggtttcggcctaaaggaaagtgcaggggaggcccgggtctcgggtgacacccccacgccttgagcgggactgtggttgcgagggagggacgagaaaacacgcctacgccctgcgtgcgctgtgctgactacctctccagcatggaggcttccagatgagcagacacccgaatcccagcgggagcccgtcaaaaatggagatttctgccgtcactctgggactcttaattcggtccgtctggggtggggcccaggaatctgcatttctgataaggtcacccgctcccctcccccattattccagtgcaaagaggtcctaggcccagtgcccatcagctcctcaagacaggaattactatatctttttctgacaactgttaactttgtacaaggttagcaaataaatccaggaatgaatggaatcttaaaactcgtaaaacaacaatgaaaggtaattcacacaaaagatacaaaatccaaaattgtcaaaaaagatacagggaaaagtaaacatccatgttattcctatagtccagccttgcaattctctccacaagccattagtggtaatggtttcttggaaatattttcagatttattttatgcccatatcagcatttttaacatcttttgtcataaatatgtcgtaaataacaatgttattgatacatatccttttaaaaacacaatggtagtatgctatactggcttgttttacttatgaatatatgtagagctgcctcgttccattgtacg

SEQ ID NO: 14298 - DNA, 372 bp, Homo sapiens
aaaagacagctgggcctgcgggaccactaccaccaagatgcggagaccagtagtggcccgaaatgccaggctgcgctgatatttattggatacaagacaaagggacagggtaaggagtgtgagccatctccaatgataggtaaggtcacatgggtcacgtgtccactggacagggggcccttccctgcctggaagccgaggcagagagagagggagagaggagacagcttgtgccattatttctgcatatcagagacttttagtactctcagtaatttgctactgctatctaaaaggcagagtcaggtgtacaggatggaacatgaaagcagactaggagcgtgaccagtgaagcacagcatcacagggaga

SEQ ID NO: 14299 - DNA, 403 bp, Homo sapiens
ctgactcagaagtctggtgtgttctgtcagcattcatgaaaccgtgaaagctaacgtgttagtttgcaaacataacaaaatatgattcatcacagttctccacgctcactagctgggcgtccctacacgagttttttaacctctcttagctgcagtttcccttctttatattataaaggggacggtggtgtgtatgtacccgccccatagcttcgtcttggggttaagtaagactgtaaaatccctaccacactggactcttcccaggacttccctttccctctttgaactctgccagagactattctgcatttgaggcctggcgatgctgggcaggggcgggtatgggtgaagcacagggtgggccgcggctggcgggtttggtgcagaaacgggctgtggc

SEQ ID NO: 14300 - DNA, 1098 bp, Homo sapiens
ctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggtgagttgaggcccagccatcatggtgggcgggaagcgcgtggccctggcggggcgccccgacgggtggggagaagggaggacacggcgtgcaggcctcgcgtgggaggctcttgtggcttggtcgccgttgggggaggttcctgtggcttggtcgcctttgggggaggttcctgggagagggtcgcggtgaggatgccgtcgtcgggcacaggggcggaaagcccgggaccctgaggaacgcgcggggattgggcctccttcgttgttaccctttaccggcacctggctcgggggcggggctgtggtttcgcggaggaatgatttaccatcctcggacgtcctcggcactgcgaagatctagcgttttcgataaaatggtggaaatcctgggccacatcgaagttccagagtgcgaaggttggaaccggagaccccttagatgaaaaatgaattaaaaaaaaaaatcaggtgatccatgaatcgattttcagcattttagatttcactaggcgcctgtttctaggacaacggtctaggtgctcaaaatgttttttttaagcactttttgttaggcagcaagtcactggcctaggaagccatactcagcagcgcgtgtcatcttctcttccaggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgcttggtaa

SEQ ID NO: 14301 - DNA, 1098 bp, Homo sapiens; identical to SEQ ID NO: 14300

SEQ ID NO: 14302 - DNA, 1097 bp, Homo sapiens
ctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggtgagttgaggcccagccatcatggtgggcgggaagcgcgtggccctggcggggcgccccgacgggtggggagaagggaggacacggcgtgcaggcctcgcgtgggaggctcttgtggcttggtcgccgttgggggaggttcctgtggcttggtcgcctttgggggaggttcctgggagagggtcgcggtgaggatgccgtcgtcgggcacaggggcggaaagcccgggaccctgaggaacgcgcggggattgggcctccttcgttgttaccctttaccggcacctggctcgggggcggggctgtggtttcgcggaggaatgatttaccattcttggacgttctcggcactgcgaagatctagcgtttttgataaaatggtggaaatcctgcgccatcatgaagttcagagtgcgacggttggaaccggagaccccttagatgaaaaatgaattaaaaaaaaaaatcaggtgatccatgaatcgattttcagcattttagatttcactaggcgcctgtttctaggacaacggtctaggtgctcaaaatgttttttttaagcactttttgttaggcagcaagtaactggcctaggaagccatactcagcagcgcgtgtcatcttctcttccaggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgcttggtaa

SEQ ID NO: 14303 - DNA, 410 bp, Homo sapiens
actatatgggagtgaatgtatctagtgacatcacccttaaaagattagatgtgtagctgtgaggtaatataagtttagctaaatggtttttatgttctattagtactgccatgccacacttcacaatttgctgtgagaagtacaaccatttctttgcctctttaaatgactacacgtcagaatgtgaagaatgagtacatctcctattttaatgattttattatcttctcttagtcttctgtgaggtttgaagaatcatacacatctttgaactgtcttagctgttgatgatgctgttatcatgggcaacatagttcaactctgagtcttggtttccttatctctgtaatggggacttaaaattgctgtcttgaagtgatgttgtggaaataaaacattgaacaaagaaa

SEQ ID NO: 14304 - DNA, 410 bp, Homo sapiens; identical to SEQ ID NO: 14303

SEQ ID NO: 14305 - DNA, 410 bp, Homo sapiens
actatatgggagtgaatgtatctagtgacatcacccttaaaagattagatgtgtagctgtgaggtaataaaagtttagctaaatggtttttatgttctattagtactgccatgccacacttcacaatttgctgtgagaagtacaaccatttctttgcctctttaaatgactacacctcagaatgtgaagaatgagtacatctcctattttaatgattttattatcttctcttagtcttctgtgaggtttgaagaatcatacacatctttgaactgtcttagctgttgatgatgctgttatcatgggcaacatagttcaactctgagtcttggtttccttatctctgtaatggggacttaaaattgctgtcttgaagtgatgttgtggaaataaaacattgaacaaagaaa

SEQ ID NO: 14306 - DNA, 4082 bp, Homo sapiens
aaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatggtaagtaatggctctgcctgtaaatccctggtggtcagtcctgtgctggctcatcttcctgtctgggttttctgaccaaatgggaaagatagttgaggtctcaccactaactggaagtcagaatgtgatgggaacaaagttagtgtcccaggctaccgggctacttcccatcccactagggacatccttttttattttttatttattattattattattttttgagatggagttttgctcttgttgcccaggctggagtgcagtggcgcgatctcggctcactgcaacctccgcctctcaggctcaagcgattctcctgcctcagcctcctgagcagctgggattacaggcatgcaccaccacgcctggcgaattttgtgtttttagtagaaacagggtttctccatgttggtcaggctggtctcaaagtcctgacctcaggtgatccacccacctcggcctcccaaagtgctgggattacaggcatgagccaccacgcctggctggggacatcctttttttttttttttttttttttttggagacggagtcttgctctgtcgcccaggctggaatgcagtggtgcgatctcggctcactgcaagctctgcctcctgggttcatgccattctcctgcctcagcctcccgagtagctgggactacaggctcccaccaccatgcttggctaatttttggtatttttagtaaagacggggtttcactgtgttagccaggatggtctagatctcctaacttcgtgatccgcctgcctcggctccccaaagtgctgggattacaggcgtgagccactgcgcccggccaggacatccttttaagtctttttttgtttccccctcccttgcatatatagctgtacttgtttcaaagcactatggaatttgcaaggggtctgctggagaccgtatttgacttgcggattgcaggccaagtggatcagtggttattggtaggaagggggacggtagggattggtgggaccttttagcagcccttctggtcaccacacagagtggttacccactgggccaatgagtacagccatctctgccctcaaattttctttttgattcagcctccaactctaaagtggcaggaaaggtggcctgttcaggagagcaaaacacaactgaggaggcgggctttaggtgaagatttgctgcagtaagtgggtggtcaggtttggtgggttggattcctccctttccaaagtacttggtagcaccctgaagtttcagtggagaatgtttattcctttggaaaatataataaactgtggaaggggaaatgatttggtgagtactgctgaggacagcaggccaaagttgtctattaataaccatgtctcataggtgttgttttgaagactgttcccatctattatttttctcctcacaaccctgtaatatattatactattaaaagcattcttttttttttttttttttctgaaacaggtcttgctctgccacccaggctggagtgaggtgcaagcagtcttcccatctcagcttcttgggtagctgatcctcaggcacatgccaccatgcctggctaattttttttttatttttttagagacaaggtgtcactatgttgcccaggcaggtcttgaactccaggcctcaagtggtcccccagccttggcctcccagagtgctgggattgcaggcataaaccaccgtgccttgccaggaccagcatttttaacgtcccttttggcagatactgaaactggagttaacattgaacttgggtttaggtcctaactttgtgactttctagctacgtgaccttgggaaagtttaattagtttctttgaacttcagtttcgaagtttcttctgtacaacaggagatatcactatttttgtgaagattatatttgggaattaatgtaaagcatttaatgcaaagctcaaaaattagcatttagtaaaatactaacttaacaacaagcaaataatgaaccagtcaacaaagatttactggtgacagtgacctcaactatttacctgaggccacacacagtagctcgttggtaaaggtgggatgcgagcacatttctctgtctctggacttcatagcctcccatactcattccactagaccagcctgcctacaggaaacactaatggcagtgcccttagcagaccagctcctgggtttcttaacgtttcaccccatttcattcagacctgttttttttcagagctgtgcctattgttagagaaacttaactcggagagttttaataatatactgattacaggagcagaaggttttttggaagctactccagaagttaggggtgtttagccccagccccaggtatactaagagcaggacttgatggttggggtttttatctccatctgccccaggatttctgtgaatgcattagcccaaagcagtcagaactttgtggcagtcctgaccagaccacttaactatttctgtgcctcactttctccagctgcgaaatgagtaaacagacagcccatcttccttctcttcccttctcaggaaagttgtaaataggctcaccctacatgttaagagtttaactgtaccattttataaaatgaaagatttcttttttgaacagcctaacaatagcatattaagttatttgctcatggcatacctagccagctaattctcttaatgaatccaggctttttttcttttgcatagcatctgattgcacaaagccaatagttaaacattttggcaggtgacgagttaatgagtatactgccagctaggtccaaatcacagacacaccagagcacagggcccttttgataaattttctttaacccaacgcatctagcaccctggccaaccatcccataggtgctcatgctgactgggttgccaaggttacaggagctgatatcataattggtgtctgagctctgcccccctaaatggccatgaggagccacttcaattcagactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggaggggtaagtgtaccttcaactttgttctctattcctactttgaaatgtattcccgcccccaaaacaaactaagtatgaaaatccaactctagtaacattagaaacaaatacttttattatttttttaaagttactgtagctgttgggagggttcccattttctttcacgtgatctttaaggcccagagtcaaagctttctgagttgggcagtcttgtctctgttgtgctaatggacattttgtatgcccagtctttgatgccatttcctaaggatcagtccacttcagaaatccaaacttctctcttccacaagtaaacactagtctgtaaaagggatctggtggcagatgtctcttttctctctcctcctgctagaccttggaatttctgtcttttctctgcctcttgtcagctccccagtgctaagctccccttgcatccgggatcagaggcattaggtgagacagaattggaggtaacctcccctgccagtccttgcctgggaggccaaatgcctaagcccccacactagaaaccactaggcctgcatgacacacactttcttttttcccccacagactccagtggaagtaagcaaggatgatcctggtgaagtaatgcagctgtgaagctcacctgaccagctgtacagttcctgttgttggtttcacataaagtaattgcacatta

SEQ ID NO: 14307 - DNA, 570 bp, Homo sapiens
cgggtggatcacctgaggtcaggagttcgagaccagcctggccaacatggtgaaacaccatctctactaaaaatacaaaaattagccaggcgtggtggcgggtgcctctaatcccagctacttgggaggctgaggcaggagaatcacttgagcccaggaggcggaggttgcagtgagctgagattgcaccactgcactccagcctgggcgacagagcaagactctgtctcaaaaaaaaaaaaattgtagagatgaaaaatacattaaatgtccatgatgttgtagcagaaaagcaaaaaatatctttggtgacctctgagagggtgtctaatagtggggtggggctagaagtcagaatgtaatgcatggaagaggcgtagattggaaaaagctttgagtatggaccacttgtttaggaagtttggtcataaaaggaaattaagaaataagacagggaaggagccacagtatcatctggaagtttttttgaggaaaggacaggggtacctgtggcttcatgatggccaagaaaagagaatcaatggagaggaactaatccaaggtgatgaa

SEQ ID NO: 14308 - DNA, 322 bp, Homo sapiens
aagaagttaccgcaccttttttttttttttttttttttttttgagacagagtctcgctgtgtcgcccaggctggagtgcagtggcgcgatctcggctcactgcaagctccgcctcccgggttcatgccattcccctgcctcagcctccagagtagctgggactacaggcgcctgccaccacgcctggctatttttttgtgtttttagtagagacggggtttcaccgtgttatccaggatggtctcgatctcctgacctcatgatctgcccgcctcggcctcccaaagtgctgggattacaggcgtgagccaatgtgcccggc

SEQ ID NO: 14309 - DNA, 3725 bp, Homo sapiens
caacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttc

SEQ ID NO: 14310 - DNA, 2082 bp, Homo sapiens
ggctggagtgcaatgtctgctgcccgggttcaagcaatcctcctgcctcagtctcccaagtagctgggattacaggcacctgccactgcacgaggctaatttttgtagttctagtagagacgggtttcaccatcttggccaggctggtcttgaactcctgaccttgtgatccacctgcctctgcctccgaaagtgctgggatttacaggcgtgagccaccacacctggccatatttttttattttttattccccattgaggtgtttttcagagtttatccttagtgatcccagttatgttttgctaatgtcagggtggtctttttatcaactactacaataaaccaccagtcgtgccagagaaaatgcccaggattaatttcttttgtaggaagagcagtttgaactatatggaatccttcaaaattctaagaaagtgtttgccctgttctgtatatattctgccaaaagttgttcctaatagtctagatattgattctttatgtaagtagggtctttttaatcaaaagtgaagtgggaccaaattgttcagtggcttgttctcttctaaattgtttttagctgataagatttgggaaactttctgggcttccacaaataatatacaatacatctttgaatacttgatgcttaaaaagtgttgttactgcatgcaatcagggagctccagagctttttgcaggctccttgttcctgagaagcaatattgttttcatattatctcggttatacattttatggttgtgacattgctttctttttgtttttgctgttgttttctgctgctgctgatttagaaatgaaataagctaactcttaattttaacctgtttgctacctaaaatggtaatcatcttgatgttctttcaagcaggtcccagagatcttaaaatgatccggaatcactgagtccacagttctcttttctcttggttatgtatagatggagagtggtcttggtgttatattagtgtatgattcgtatttgtttcataattaacttcgaagtgaaaaattgatgcgagagcaaaggtttatttggtttccataactatttactaattttatgcttgccagattttaagattaaactgtttgccatctcttttttttttcttcccgtaaaacctttggccatctacagtcacttttcctcaaatcttatgctgtaattcaaactgtatattctttttgctgattgcttctgtacctcctctgcttccagtgttcttttgcaagagtgtccacacagtgggaagaaaacctgaacttgactcatgaagtgctgggcattcaaaacagtgaatccttgcaaaggatcttgggagtagacccctgtgaattggctctttcaatttgtccacttaaagggcataatagattatgcagctgtttgggcttcagcagggtattgctccatattcatgcctagttgcaattatgtgaattttcagtttgttacaaagacttccctttgtattcaaaacaattttgttggctttgtgttctaatatttgagttttctctgaggaaaaatagttgcaagattttgaactttgaaaacttcaaattaaaatgtttaaaggttttgtcactttttattttctgatgcaaaccatacattgaaagcatattttaagaagaagtcactctaataagctttaatttcgagtttatgaatcacaggatttttggtagaggtaaaaactatacttacaccgtaaattagacattaaatgccatttaatcagtcagataatgattaatgttagagtaatgtttgatgggccaagctgctaaaacataagcagttctaattaaaatatataaacttatcacgtaaaaatagcaaacttagtaatgtataaagtgacagtaggtcttttttgcttaaaaatcagagttcctgtgtagtgtctctttatgatctctgtagtaaaaatattatttaacgtagcttagtgagaagtttaagaggagtataccttttactttagggtgcccatgccactttgaagttatggagtgcaaagtagtttccacacattaaaaaaaaaaaaaa

SEQ ID NO: 14311 - DNA, 2499 bp, Homo sapiens
aggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatggcaagtattttttatattgtatgttttcctgccaaatcaaccaacttaatgacaaatttaagtgctttgatgcagtacttgaaaatataaatcatttcctaacagctgaatacaaactaatatgccaaaatattacctcacaacttctttctaagctagttcaaacaacagataacctcttttgcatttaaggatggtactaaaaatgtacttatttctctttgtcttgaaaaaatgataaaaattgattagtgacactgtaattccatcttgctgagttcacacacattctcaaatgcttagtgtgcactgtgtcctctagtcctacaaggctttggtgacataaggcttctgtatggcccttttactcccttttcggtttggtttgtctttgggcctatttttttctaatcctagggttcttttttttttttgacagcatctcactctcttgcctaggctggaatgcagtggtgcagtcatagcccactgtagcctcaaacttctggcctcaaaccatcctcttgccttggagctcctaaatagctgggtctacagatatgcgccaccatgcctagctaatttttatgttttgtagaggcagggcctccctatattgcccaggctggtcttgaactcctggcctcaagcagacctcccactttggccttccaagtgttgggattacaggcatgagccaccacaactggcctaatcctagagttctttaggatactagctacttcagactcacgctaatgtcttaatggagagtgaaataactaagaggagttacagcaagcttgtccggcctacagcccacatgcaacccaggaaggctttgaatgtaacccaacacaaatttgtaaacattcttaaaacattatgagatttttttgtgtgatttttgttttttagctcatcagctattgttagtgttagtatattttatgtgtggcccaagacaattcttctaccagtgtggcccagggaagccaaaagattggacacctctgagttatagtgttgagccttaagatcaatcttatgatttcacctttccaatttttttattccaatggcttgtggataatataagcattcatttgcaaaaacaatactgagtactagtatatgattagtatcagccctcttccaaaagacaaagagagacaagtagctagccatgcaggtctgtaaaaagttgacagtgatggtatcaaatatggagtcaaatctgggttttcattttaggtgttacttttgagaaatgcagattactgtaggcattgaacattatagcctagtcttgctgcttgaatttcctaacttactatctggcccaactgcttcctctcctaacacccctctccacaaccttctaggttttcaaggacattagtaacaatgacttttgtcattaataaaagctgtaaaaagggacatctatacaattgagaaacaacagagaggaaaggaagctacttttaggaacctatatgtggcctactcattactggcccagtttcttcaaggaaagcttactccattctaagggtgaagattttagtcaagagcttgattagtgtttgacactttgatagaaaaagcagagtggtgactgcttatttattcaaagttttcttttcccaacaacgttcacatctgtgggtcataagcatgaagatgcccagcataggttattatcgaaagaagaggcccccttcacaaacctgcccagttattacatatgctacctgttcatttaccatagaaagatgtacccacttttccagaattattttgaaaaaataactgctaattttggacacttaataaaatggaaagtaccactgagataagtttaataccagaataaatgcatattatactcgaatgcttacaatatgagaatatagcaacagcctgttttgccttaccaggacatcaagaatctgatcagtttcacaccttttactggcatatagtaatagaggatggaaagataaggtctcaaatactgtgatctggccaggcacagtggctcatatctgaatcccagcactttgggaggctggggcggacagatcacctgaagctggcagatcgcctgaggccaagagttcaagaccagcctagccaacatgatgaaaccctgtctctactaataatacaaaaaattagccgagcatggtggcacacgcctgtaatcccagctactcaagaggctaaggcaggagaatcgcttgaacccgggaggcagaggttgcagtgagccgagatcgcgtcattgcactgcagcctgggcgacaagagcaaaactccatctcaaaataaa

SEQ ID NO: 14312 - DNA, 119 bp, Homo sapiens
agaatcgcttgaacccgggaggcagaggttgcagtgagccgagatcgtgccattgcactccagcctgggcaacaagagcaaaactccgtctccaaaaaaaaaaaaaacaaaaacaaaaa

SEQ ID NO: 14313 - DNA, 2499 bp, Homo sapiens; identical to SEQ ID NO: 14311

SEQ ID NO: 14314 - DNA, 323 bp, Homo sapiens
tctggatgacagaacaaggctccatctcaaaaaaaaaaaatgccagaagaaaatgtgtttttctcttttgtgttaaatatggtaactttttctaggtataaatattaatatgctgatcaattaaaatgatgaaattattacaataatgatgaataataaaattccaaataatttcccagtccctttctaaaattcctaacttgccaatgctactagtcttaacattgcttacaaattgttttaaattgttgccttcaactttatggtttttttcaaaaagctgtttttttaaataaattgatttagttactgtgttctaaaaa

SEQ ID NO: 14315 - DNA, 492 bp, Homo sapiens
ggaatacaaagtttaaatgataaagttcctgccttagagacgtttattgtctactggagaaggtgggcatataatttacccaggtgagtaaataatttataaactcaagtaattagcattgtaatagaagttgcctagtacttgtgtatctactatctctgctaaaaggattgaggaaagctttactgaggagctgtcatttgagcttggtcacaaaagatgagaaggaatttgccaggtaaatttgttcaggaatcagagattctagacaaagggaacttcatgtgcaaacgtaaaagagcatggcaatgttggaaaggatcaactggagctagagcatgggactctgtatatgttgggagagatgaaatgagaggcatggtggagcttaagtgctgtgctatgaatgttgacctcatcctatagacagcaggaaacaaagtttttaagtggtaggtgatactataaggcttttttcaaaaaaagaaaaag

SEQ ID NO: 14316 - DNA, 323 bp, Homo sapiens; identical to SEQ ID NO: 14314

SEQ ID NO: 14317 - DNA, 492 bp, Homo sapiens; identical to SEQ ID NO: 14315

SEQ ID NO: 14318 - DNA, 990 bp, Homo sapiens
gtgtccttgggctgtgtgtggtctgcgtgtccctggggttgtctgtggggtcatgtggcccctctggctgcctggtttccttttctcccacatcgtgtctggcatttctttattcagaaatgaggcatctgttgttggcttccctgtggagtttgtgtccctccctgagctcccgcctctgtggggccagccccagtgtggacttgtggccccctgtgctgctgggcctcaggtttgggtctgcggagtacatgggtgtgagtgctctgaccactggactcttaaaacatgcagccctctttgactgtgacactggacatgtgcaaagcttggggactgatcaaaaagtataaagaggccattgaaaaagaccttgactcctgcacccagaggtagcaccaagaacatggcatgcatttcatctccacgtctcccttctctcctttcctcccctgttcattcattcagccaatctatcagccaaccagtaagcactcacggacacccacgtgcgcaggtgccatggaggcagccgagtgtggggactgctgtggcagagctggcagccttgtgtgcttcctgcacttgtgacattttattgcagccagtgcctgtgccattaagcattccttgaaaataaaatcttttttggctgtacgatgtttcttcgtgtagacataccaaaagtaaactcttggccggctgcggtggctcatgcctgtaatcctagcactttgggaggctgagacgggtggattgcctgagctcaggagttcggaccagcctgggcaacacggtgaaaccccgtctctactaaaatacaaaaaattagctgggcgtggtggtgtgtgcctgtagtcccacctactcaggaggctgaggcaggagaatcgcttgaacccgggagacaaaggttgctgtgagcctagatcacaccattgcactccagcctgggcgacacggagactccgtctccaaaaaaaaaaaaaa

SEQ ID NO: 14319 - DNA, 1118 bp, Homo sapiens
tgagaatttgcatttccaacaagttcccaagagattctgatcctgctggtcgagagtaacaatttaagaatcatcattctaggttatatacctgggagtggaattactgtgatatatagggtatgtatatctcaatttctaatgtaacagggtttcagagatcctcttcacattcttgccaaaactttggagtattattttgccagcctaatcagcttgaaaagttatctcattgttttaatttgcatgtttctgatttccagtgaggttatgcatgtattcttaacatttattggcctttcaggaactttctgtgagttacctgttacattcctttgctgaatatttaatcgtttgttttttcatatttatttatagggattattttaaaattctgcatatgaatcctttctgttgtttagcaaatatctttgcccagtggatgacttaccttttaactttgttcctgatgtcttttgttgagcaaaagtctttcattttaatgttatcagattatcggtattttattcaatggtttgtgctttttgaatcattttaaggagatccttccctacaaatcaataagaaaaatacaaacaacacaataaaaataaaagtgtttataaaaacagacataacaggcagttcacagaggcaaaaacaccagtggcctatagacttaagaaatctcattagtaatcaataaaatgcaaaataaatctatactatgatatatacatttagtacttagaatgctggcatatatttaaaggcctgacaatgccaagtattggtgaacatacgaaacaataagaactctatgtaacctcagcactttgggaggccgaggccagcagatcacctgaggtcaggagttcgagaccagcctggccaatgtggcaaaaccccgtctctactaaaaatactaaaaattagccgagtttgatggcacacacttgtaatcgcagctgctcaggaggctgaggcatgagaatctcttgaacccaggaggtggaggttgcagtgacccaagatcatgccactgcactccaacactccagcctgggtgacagagcgagactctgtctcaaaaaaaaaaaaaaaagaaaaagaaaaaa

SEQ ID NO: 14320 - DNA, 1138 bp, Homo sapiens
tgagaatttgcatttccaacaagttcccaagagattctgatcctgctggtcgagagtaacaatttaagaatcatcattctaggttatatacctgggagtggaattactgtgatatatagggtatgtatatctcaatttctaatgtaacagggtttcagagatcctcttcacattcttgccaaaactttggagtattattttgccagcctaatcagcttgaaaagttatctcattgttttaatttgcatgtttctgatttccagtgaggttatgcatgtattcttaacatttattggcctttcaggaactttctgtgagttacctgttacattcctttgctgaatatttaatcgtttgttttttcatatttatttatagggattattttaaaattctgcatatgaatcctttctgttgtttagcaaatatctttgcccagtggatgacttaccttttaactttgttcctgatgtcttttgttgagcaaaagtctttcattttaatgttatcagattttcggtattttattcaatggtttgtgctttttgaatcattttaaggagatccttccctacaaatcaataagaaaaatacaaacaccacaataaaaataaaagtgtttataaaaacagacataacaggcagttcacagaggcaaaaacaccagtggcttatagacttaagaaatctcattagtaatcaataaaatgcaaaataaatctatactatgatatatacatttagtacttagaatgctggcatatatttaaaggcctgacaatgccaagtattggtgaacatacgaaacaataagaactctatgtaacctcagcactttgggaggccgaggccagcagatcacttgaggtcaggagttcgagaccagcctggccaatgtggcaaaaccccgtctctactaaaaatactaaaaattagccgagtttgatggcacacacttgtaatcgcagctgctcaggaggatgaggcatgagaatctcttgaacccaggaggtggaggttgcagtgacccaagatcatgcctgtgcactccaacactccagcgtgggtgacagagcgagactctgtctcaaaaaaaaaaaaaaaagaaaaagaaaaaaaagaaacactataagaattc

SEQ ID NO: 14321 - DNA, 1141 bp, Homo sapiens
tgagaatttgcatttccaacaagttcccaagagattctgatcctgctggtcgagagtaacaatttaagaatcatcattctaggttatatacctgggagtggaattactgtgatatatagggtatgtatatctcaatttctaatgtaacagggtttcagagatcctcttcacattcttgccaaaactttggagtattattttgccagcctaatcagcttgaaaagttatctcattgttttaatttgcatgtttctgatttccagtgaggttatgcatgtattcttaacatttattggcctttcaggaactttctgtgagttacctgttacattcctttgctgaatatttaatcgtttgttttttcatatttatttatagggattattttaaaattctgcatatgaatcctttctgttgtttagcaaatatctttgcccagtggatgacttaccttttaactttgttcctgatgtcttttgttgagcaaaagtctttcattttaatgttatcagattatcggtattttattcaatggtttgtgctttttgaatcattttaaggagatccttccctacaaatcaataagaaaaatacaaacaacacaataaaaataaaagtgtttataaaaacagacataacaggcagttcacagaggcaaaaacaccagtggcctatagacttaagaaatctcattagtaatcaataaaatgcaaaataaatctatactatgatatatacatttagtacttagaatgctggcatatatttaaaggcctgacaatgccaagtattggtgaacatacgaaacaataagaactctatgtaacctcagcactttgggaggccgaggccaccagatcacctgaggtcaggagttttagaccagcctggccaatgtggcaaaaccccgtctctactaaaaatactaaaaattagccgagtttgatggcacacacttgtaatcgcagctgctcaggaggctgaggcatgagaatctcttgaacccaggaggtggaggttgcagtgacccaagatcatgccactgcactccaacactccagcctgggtgacagagcgagactctgtctcaaaaaaaaaaaaaaaagaaaaagaaaaaaaagaaaaacaataagaattctaa

SEQ ID NO: 14322 - DNA, 911 bp, Homo sapiens
attctagatgagggatattaaaacagtttgtttgactgattgaatttctaatagttcgggggtatttatactattagttcaagggtagctttgtttttatttactttttgttatgaaatattaatataccaaaagttatatagaataatatagcaaatacctgtgtagccagccaacctttattaatcattatcaattcctaatattttccatatttgcttaattaaaaaaataataaagcattatagatattcctgaagacttccacatattcctcaccaatcccattctcctttatcctttccagatgtaaccactatcctgaatttgctatttataattcctgtgcacgtttttatatttttactacatagccatatattcacaaataacatatagttttatatgttttaaaactatatagatgacatactctatcattctacaacctttttgactcaatatgcataatgcttttgaaatttatttctaaagatacaaggaactatatagtattccattgtagaaatagaccatcatttgttatatttatccactttcctgaagatttgttctttctgttattttgctattacagttaattctgcaacaagtattatcatacacctcttgttgcacatatgccagactttttctaggacagtgtttttcaaacttagattacaattagtaggttacaaccaatgggatttttttaatgaaatggaatagaatagaaaatatcaaaaagtgttccctacagtatgttagggtaattactgtttcttaaagctttttttttatatgtgtttgtgtatatgtgacataatgtgtgtggggccacattgaagaatgcagttcttcgtgtagatctcaatcaaaagtgttgggaaggtgtcattctattacag

SEQ ID NO: 14323 - DNA, 1071 bp, Homo sapiens
aggctcttctagccttcctgtctcatctaagagagaaaaaaagctgtgaagtgcttgtgaaggttacaggctggagacacaggcacactaaaagattgagacttcatcataggattagagaatgcctccccttccacaccttgctactacatcaacagagcttcagtataataatcgtggattatagctgaaagacctgcaaggatcagactctatttaaggaggtttttttgttgctgttttgttttgatttgtttttttttttttttgtaaatccaaaggaaacaagggagacaaaaagacagtagaagaaacagaaacttctgacacctacagctacatcaaacattaagcacagcccaactcctggccagattaacataaaacctcatactaatggtctctttggattagttcctattacttgatagatcatgtccagttttcaacaaaagaaattataacgtatgctaaaaaaaaaaaaaacacacattctgaagaggcaaaacaagcgtgagaaccaaattcaggttttggaattatcagatatggaatttaaaataaccacgattaatatactaagtaggctatgaataaaagtagataacatgcaagaccagatggctaatctaaacagagagaaactctaagaaagaatcaaaaggagttgctagaaatcaaaaacactgtaacaaatgaagaatgcctttgataggctcatcagtaagttggaaacagccaaggaaggaatcagtaaggttgaagacatggcaataaaaacttcccatgctgaaatacaaaggaaaaaaagactgaaaaaaaggaacagaatatccaagaactatgggacgatttcagagtataacatacatgttattggaataccaaaaggagaagagaaaaagaaggagaagaaatatttgaagtagtaatggatgagaattttccaaaattaatagcagataacaaactacagatctgggaagctccaagaacaccaagcaggataaataccagaactacacctaagcgtatcatgttcaaactacagaaagacaaagaaaagatttt

SEQ ID NO: 14324 - DNA, 911 bp, Homo sapiens; identical to SEQ ID NO: 14322

SEQ ID NO: 14325 - DNA, 462 bp, Homo sapiens
aggctcttctagccttcctgtctcatctaagagagaaaaaaagctgtgaagtgcttgtgaaggttacaggctggagacacaggcacactaaaagattgagacttcatcataggattagagaatgcctccccttccacaccttgctactacatcaacagagcttcagtataataatcgtggattatagctgaaagacctgcaaggatcagactctatttaaggaggtttttttgttgctgttttgttttgatttgttttttttttttttttgtaaatccaaaggaaacaagggagacaaaaagacagtagaaaaaacagaaacttttgacacctacagctacatcaaacattaagcacagcccaactcctggccagattaacataaaacctcatactaatgggctctttggattagatcctattacttgatagatcatgtccagatttcaacaaaagaaatta

SEQ ID NO: 14326 - DNA, 911 bp, Homo sapiens; identical to SEQ ID NO: 14322

SEQ ID NO: 14327 - DNA, 238 bp, Homo sapiens
acagggccaggagatcgagaccatcctggctaagatggtgaaaccccgtctctactaaaaatacaaaaaattagccaggcatggtggcgggcgcctgtagtcccagctactcgggaggctgaggcaggagaatggcctgaacctgggaggcagagcttgcagtgagccgagatcatgccactgcactccagcctgggtggcagagcgagactctgtctcaaaaaaaaaaaaaaacaaa

SEQ ID NO: 14328 - DNA, 181 bp, Homo sapiens; identical to SEQ ID NO: 7550

SEQ ID NO: 14329 - DNA, 364 bp, Homo sapiens; identical to SEQ ID NO: 7112

SEQ ID NO: 14330 - DNA, 142 bp, Homo sapiens
gcgggcacctgtagtcccagctactcgggagactgaggcaggagaatggcgtgaacctgggaggcggagcttgcagtgagctgagattgcgccactgcactccagcctgggcaacagagcgaaactccgtctccaaaagaaa

SEQ ID NO: 14331 - DNA, 247 bp, Homo sapiens; identical to SEQ ID NO: 7113

SEQ ID NO: 14332 - DNA, 170 bp, Homo sapiens; identical to SEQ ID NO: 7565

SEQ ID NO: 14333 - DNA, 184 bp, Homo sapiens; identical to SEQ ID NO: 7572

SEQ ID NO: 14334 - DNA, 131 bp, Homo sapiens; identical to SEQ ID NO: 6213

SEQ ID NO: 14335 - DNA, 227 bp, Homo sapiens; identical to SEQ ID NO: 7587

SEQ ID NO: 14336 - DNA, 47 bp, Homo sapiens
gcactccaacctgggcgacagagcaagactccgtctcaaaaaaaaaa

SEQ ID NO: 14337 - DNA, 91 bp, Homo sapiens; identical to SEQ ID NO: 11440

SEQ ID NO: 14338 - DNA, 143 bp, Homo sapiens; identical to SEQ ID NO: 7597

SEQ ID NO: 14339 - DNA, 686 bp, Homo sapiens; identical to SEQ ID NO: 7114
  misc_feature (95)..(95): n equals a,t,g, or c

SEQ ID NO: 14340 - DNA, 141 bp, Homo sapiens; identical to SEQ ID NO: 7393

SEQ ID NO: 14341 - DNA, 184 bp, Homo sapiens; identical to SEQ ID NO: 7604

SEQ ID NO: 14342 - DNA, 108 bp, Homo sapiens; identical to SEQ ID NO: 11444

SEQ ID NO: 14343 - DNA, 105 bp, Homo sapiens; identical to SEQ ID NO: 7608

SEQ ID NO: 14344 - DNA, 175 bp, Homo sapiens; identical to SEQ ID NO: 7613

SEQ ID NO: 14345 - DNA, 189 bp, Homo sapiens; identical to SEQ ID NO: 7630

SEQ ID NO: 14346 - DNA, 207 bp, Homo sapiens; identical to SEQ ID NO: 7631

SEQ ID NO: 14347 - DNA, 162 bp, Homo sapiens; identical to SEQ ID NO: 6214

SEQ ID NO: 14348 - DNA, 171 bp, Homo sapiens; identical to SEQ ID NO: 7638

SEQ ID NO: 14349 - DNA, 100 bp, Homo sapiens; identical to SEQ ID NO: 6215

SEQ ID NO: 14350 - DNA, 129 bp, Homo sapiens; identical to SEQ ID NO: 7645

SEQ ID NO: 14351 - DNA, 193 bp, Homo sapiens; identical to SEQ ID NO: 7396

SEQ ID NO: 14352 - DNA, 177 bp, Homo sapiens; identical to SEQ ID NO: 7651

SEQ ID NO: 14353 - DNA, 140 bp, Homo sapiens; identical to SEQ ID NO: 6216

SEQ ID NO: 14354 - DNA, 114 bp, Homo sapiens; identical to SEQ ID NO: 6217

SEQ ID NO: 14355 - DNA, 114 bp, Homo sapiens
cagtagaatggcatgaacccaggaggcagagcttgcagtgagctgaggtcacgccactgcactccagcctgggcaacagagcaagactccgtctcaaaaaaaaaaaaaaaaaaa

SEQ ID NO: 14356 - DNA, 364 bp, Homo sapiens; identical to SEQ ID NO: 7112

SEQ ID NO: 14357 - DNA, 153 bp, Homo sapiens; identical to SEQ ID NO: 6795

SEQ ID NO: 14358 - DNA, 121 bp, Homo sapiens; identical to SEQ ID NO: 7669

SEQ ID NO: 14359 - DNA, 166 bp, Homo sapiens; identical to SEQ ID NO: 7670

SEQ ID NO: 14360 - DNA, 190 bp, Homo sapiens; identical to SEQ ID NO: 7674

SEQ ID NO: 14361 - DNA, 2364 bp, Homo sapiens; identical to SEQ ID NO: 6735

SEQ ID NO: 14362 - DNA, 158 bp, Homo sapiens; identical to SEQ ID NO: 7682

SEQ ID NO: 14363 - DNA, 193 bp, Homo sapiens; identical to SEQ ID NO: 7690

SEQ ID NO: 14364 - DNA, 95 bp, Homo sapiens; identical to SEQ ID NO: 8302

SEQ ID NO: 14365 - DNA, 108 bp, Homo sapiens
ggagaatggcgtgaacccgggaggcagagcttgcagtgagctgagatcacgccactgcactccagcctgggcgacagggcaagactctgtctcaaaaaaaaaggtaaa

SEQ ID NO: 14366 - DNA, 136 bp, Homo sapiens; identical to SEQ ID NO: 6219

SEQ ID NO: 14367 - DNA, 192 bp, Homo sapiens; identical to SEQ ID NO: 7720

SEQ ID NO: 14368 - DNA, 150 bp, Homo sapiens; identical to SEQ ID NO: 7399

SEQ ID NO: 14369 - DNA, 142 bp, Homo sapiens; identical to SEQ ID NO: 7400

SEQ ID NO: 14370 - DNA, 123 bp, Homo sapiens; identical to SEQ ID NO: 6220

SEQ ID NO: 14371 - DNA, 45 bp, Homo sapiens; identical to SEQ ID NO: 6221

SEQ ID NO: 14372 - DNA, 243 bp, Homo sapiens; identical to SEQ ID NO: 10081

SEQ ID NO: 14373 - DNA, 307 bp, Homo sapiens; identical to SEQ ID NO: 7758

SEQ ID NO: 14374 - DNA, 131 bp, Homo sapiens; identical to SEQ ID NO: 7764

SEQ ID NO: 14375 - DNA, 288 bp, Homo sapiens; identical to SEQ ID NO: 7116

SEQ ID NO: 14376 - DNA, 268 bp, Homo sapiens; identical to SEQ ID NO: 7767

SEQ ID NO: 14377 - DNA, 160 bp, Homo sapiens; identical to SEQ ID NO: 7770

SEQ ID NO: 14378 - DNA, 368 bp, Homo sapiens; identical to SEQ ID NO: 6222

SEQ ID NO: 14379 - DNA, 2925 bp, Homo sapiens; identical to SEQ ID NO: 6223

SEQ ID NO: 14380 - DNA, 288 bp, Homo sapiens; identical to SEQ ID NO: 7116

SEQ ID NO: 14381 - DNA, 4704 bp, Homo sapiens; identical to SEQ ID NO: 7404

SEQ ID NO: 14382 - DNA, 102 bp, Homo sapiens; identical to SEQ ID NO: 6224

SEQ ID NO: 14383 - DNA, 2305 bp, Homo sapiens
tacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgagtagctgagattacaggcgcctgccaccacgcccaggtaatttttgtatttttggtagagacggggtttcaccatgttggccaggctggtctcaaactcctgacctcaggtgatctgtccaccttggcctcccaaagtgctgggattacaggtgtgaaccacctcgcccggccatctactttttttaatagccctccttatcacctttattcatttgactcactgatgattcccaagtgctaagaacaatgtctgtcatgtaattgatgaaaactttgttgaattaatacctttgttgtgttttattcacactgtatatacaatacctggatgaagagagatatttttagcactattaaaatacatgcattggctcaatacatgaattggatcaattctggaaccctaacaagatcacatttttgaccaaagtcaatatcttggactatagttaatttatcaaggtaaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgccttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgtgtactttcttcagtgccaggcactcttctaaccactttatatgtattagctcatcagactcagcctgataatatgagatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttaggaggccaaggcaggaggactgcttgagcccaggagtttgagaccagcctggacaacaaagtgagattcatctctccaaaaaaaaaaaaaaaa

SEQ ID NO: 14384 - DNA, 254 bp, Homo sapiens
ttcttttctttttttttcttttagacggagtcttgctctgtcgcccaggctggagtgtagtggcacgatctcggctcactgcaagctccgcctcccgggttcacaccactcttctgcctcagcctccagagctgctgggactacaggcgcccgccaccatgcccggctaattttttgtatttttagtagagacggggtttcactgtgttagccaggatggtctcaatctcctgacctcgtgatccgcctgcctc

SEQ ID NO: 14385 - DNA, 1104 bp, Homo sapiens
ccgtatcagcatcagcaaactgaacactgaatgattcttactccaagaggcaagtcttagtggtttctattttaactgaaggagagattaatttctgtgcaaggttgaaaaaggtgaccacaaattctttgggcttctttcatcaagaggtgaagtccattaccccacgccttaactctgggctggctttgttgttgttttggccaatagaatatggctgaggcgctgcttccaagattaggcctgaattgagatgccctagcagccaggcagcacctgccagagcatgaataaggctatcttggaccgcccagcgtagccaacctgtgctgaatgaagccacatgaatatgcccaggagaaactagcagaagaatcacccaccttgcccacgttagagatataaaccactatttgaggcagtttgttatgcagcaaaacttagccgaaactattaccttgctaccttgactgctggtgtaatttcccatctcatggagtcacagagttttcttgccaactgcagtgagttggcaaatgggaatgatcagtagcctcagtgtgttttctgatccactccatcctgtattatcatctgcgaataccgtttttcctttaaatgcaatgtgtctttcaaagctgacttgaatttctcacctttcgagttacctgccatttggactcacttatttggaggagatatgtaaagacccagcgtaatacctgtatgctcaataaaaagtatttgctggtactccttcctgcccgtcgtgtgacctgactgctctgggcttctgggggctccccctaaactcgctccacgaaatgacccctccaacctggcacgcccgctctcctaccttcgcccagggctggccgttatctctgtgctgtcacgcggggaagtcccatctgaactggggccttatgaccttcggtacttttattcgaacgtagcctgcgtccctgcctggaacctggttcccgccctgaaggacccttacttagcactcctgcgggctgccgggaccccacggctccgcaggcggagagactaggcgcgatccctgcgcgcccctccttctcttgcgcttcagggggccgg

SEQ ID NO: 14386 - DNA, 1214 bp, Homo sapiens
gagatttttactttaaaaagcttctctcttaatctgggttttatattaaggggctcctcttattttacttctttgttcattgcactataaatatgaatataatgagagatctagtcttaaaaattgtatttttttacaacttcttaggcataacttgtttcacagttgctagaacaaacctcatcaacccagtttttgaacagtagaatattctctttgagaaaaagataggtaattagcattttgttctttctcatgtcattttccttggaaactatactgccttccttctccagttttcccaaatcagagaacaaaagaaggagggttgctgaaatgaaccttgttctttctggctgtcttcttacccattcctcagtgctgaactttttggggtgagagtgggggaatagggttggcagttgtctgccacggccccttacttgtttctggggaagacattcgaggtactcaccaagagatagagtgaagatggaattctttttagaagggaatacagttgacccaggaacagtgcgggggtgtggttagaagcactgaccttcttccctctgcagtcgaaaatcctcacgtgactttttttttttaaggctctgtcgcccaggccggagtgcagtggtgaaatcatagcttgctgcagcctctattgcccgggccaaagcaatcttcccacctcagcctcctctagctgggacaacaggtgttcacccttcctggctaagttttttgatttttagtagagatggagaatttcccaggatggtctcaaacttctaagcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattattactgtgttcttacaatcaagtaagctagagaaaggaaaatgttatgatgaaaatcataaaaaaaaaaaaaagcccggcatggtggtgtgtgcccgtagtcttctgttactcaggaggctgaggtgagaggattgcttgagtccagaaattcaggctgtagtgagctatgatcgtgccgctgtactgcacccctggtgacagagcaagaccttgtctcttgaaaaaaaaaaaagaaaa

SEQ ID NO: 14387 - DNA, 560 bp, Homo sapiens
gtagttttcttcccccctccgattatgcttaagtctttagttaaaactctggcatgcaccattgaatccttagtcagaaaatttactaaaaaatactgtgtacctttgcaaggctgtatttatatatacagaacctttaggttctttcctctcagatatctccttctgatttcttgtaatctgttaacagagtgtgtctagtaatgttatattaatgtcatcttaataatagctcatattaaaagttatttcaaattgctaggactaattaaaaaggcttctgacaaagggtattgctttgggcagagagacattttgatatgtaaattatataaattgttatctctatttttttccaagctttttgtagtaaaccatatttttataagttatatagtatagaatttagaggttgaaaaaatttttaaaaatcattcaccatgtttataaatgttaaactttgatattacttgtataaaactaagagaattatttttcccttttcattctctttcactgttacgcattttctttttaagttattatttgaataggtaaca

SEQ ID NO: 14388 - DNA, 221 bp, Homo sapiens; identical to SEQ ID NO: 10402

SEQ ID NO: 14389 - DNA, 16312 bp, Homo sapiens
gtttccgggcggggacactcagggcgcgacgcttttctgttacccacagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggtggggaccgcgcaggaggatcagaacggggatgggcgccggaaggggccgcgggaggatggggccgggatgggggtgctggtgtaggccgcgggagggtggggccgggagggcgcggggcgggtcggagggcacttgtggggatgaaggcggctttcaagggacgtttctgaaacttgattccgatcacgtggctttaaaaaaaagcggccactgctcccatagacggctttatcaggcattgacataccttcaaggccccattcgtccctccaccctgacagtgcctaaccttgcatttaactgtgtattgcagtacctagtagtcaataaatccatgttgaatgaatgaatgactggtaggtgcctgttttcttatttgaacactgatgatgtgtgctgtacatctcccctagtttgttgggagaattgcgtgacatcaggggtattaaagtactttccagtgtgataccaacgttaagtggttatttttccaccgagaagttgatgaacaagaaattctgcaaaataagttggtctctaggatacataatgtgcattttagtaattccttattttaacccctgctttaggaatcagtaacatgatagccaagcttgccaaaacctgcaccctccgcatcagccctgataagcttaacttcatcctttgtgacaagctggctaatggaggagtgagcatgtggtgtgagctggaacaggtgagcaaaagcttctgagaggcctgcacactctgcagattgtcactggaaagatcacatataccctccctcatccctcattttttttcccttaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctggtgagtaggagagtcagggtttctaacacagaagtcttggcctcgaaggaatagacatagttagcctagcctttttaacaataaatactgttgaaagctgtttggtttatttaaatttaaagatctggtccataactatattttgcattagagtcagttcctcctcattttaaaattgtgttgttatcatatgcattcagctagaatgctgctttttccaagccgtgaaacttccagcctctctgtttcttgtagtggtattgtcaccttgtctagaaatcatggtttctctatccattttcacctttgacatgttttctccccactcccaccctgcctcatctgctataataacctttaaatggcccctcgttcttcagtacacgtatgttttatatgctactgccagatgaatttagtgcacagctgtcctccaaacacacaaatacacaaactcatgcgcatacatacaatccagagttgctcttcctactcatagaatgaggttcgtatttccttttttttgagacggagtctctctatcacccaggctggagtgcagtggcgcgatctcggctcactgcaacctccatctcccgggttcaagcgattctcatgcctcagcctcctgagtagctggaattacaggcacccaccaccacacccagctaatttttgtatttttttagtagagtcggggtatcaccatattggccaggctggtctcgaactcctgacgtcaagtgatccacctacctcggcctcccaaagtgctgcgattgtaggcatgagccacggcgcccagcccagcttttcttcataactctcaactctttgcagtcaggcagttctcagagctaattagggcatttcatgtcacagtataagtttggtatgttttttctattgcttaaggaaaagcaagatagtaacgtataatactttttgtccaaaagtgcaagatattttggtctgtgagtctcataggagcccctagaaataaatatagtttgccttttaactgttagaaactgcagcactctgagtgtcctatgcccaaagaatggccttctcttggttgcgtcaacatagcaggcttgcttctttctgcctcacggctttacatgtgctgtttccccagcctgaaaccctgtccccttgttcttgtcttcccatggctgctgcttctcctgcttttggtggtatctgaaatgtcacctcctcagtctaaggaaactcccccacactcaccctggtctctgtggagtgctttctcacggctataatgagcatttcatacagtttcatttgtttgcatttttattgatctgtttgttccactggaacactaaggacctttttgtcttatcaccacacttcccagttcctggaagtacccagagtctgttccataaatattggcaccatcaatattggtcgaatggcttttgagtgaataaactgacagcattccacttagatttggtatttcaacttttttgtcccgggtcttcgggtttgttttgttgttgcttaatattaacaacataaaaatatttttaaattcttttcttggcagttatctatgtcaagcagtagccgcattgtgacccatgacatccccataaaggtgattcctaggaaattgtggaaggacttacaagaaccggtggtcccagatcctgatgtaggtgatgcctgcagtcctgctgtacaccccacattaaatggcatgacttgaattctctagttttagttgtagtcttgcagtatattttatttttaaaggatacttaacgaaaacattagattatttgccttttgttatttacataaagcatcttaaaaatgttgcatatgatagaaatgtcatgccatcctatatgtagaaaatgtctcgctcagtaacatcacttaaaacacaaatgatacttttggaggacaattagtatttattagtattcttggccttagacaccaatttgggtttcacaggacttgatcttttcctcagccggtcaggagcgatatctggatgtgcacgaaagccaagaagagaagaatttcatggcttagggctaacatggggtaacggtcatgccgatggttaaccctagagctcctgaaagtaaagatgatgccaaagggcccatttcctcttgctcacaatttgtttaagaagaaagtacagaaatatgctgggtaaaataattacttgacttttactagatggcacctacactgattttgaaaaagcctgtgttttatagagcactcttggtaacagtctcagatgtgatgcagtgactgtctgccatgtttttgtacagagcatggaaaaggcccttgaatcataggtgtaaatgtcccttagaggagggcctcctgctgattgcctgagttatattccccctggaccaatataggggcatctcagctgaagtaccctattccttcttgagccaaaagaatgcccacagggacatggttgctgaggtaaccagaggcaggcattccattctttaattttgcttgagcatccttgagttagtgaaatagaattggttttctttttatatttttaaaagaactttattcagaaaattgtaaaatagtatcccatagtttttgagcatgcatgtgttctagagttagttatggggcccttgtcattactagagtatattaatatttttaatacttgtgcttttttctcattggttttgtaggttagtatttatttaccagtcttgaagactatgaagagtgttgtggaaaaaatgaaaaacatcagcaatcaccttgtaagtcacaacttctttagaaaagaactctgaagtatttggtgggacggcgtgggttctccagctcaccctgcagcagtccatgcaggtgggcacctcctaaccgagttcccacttatgaggacctggcctggtgctgagaacctgcagattgctagttggatttagaaacctattccaatacttttcaactctaattctttgaggaaagcttttatatttgcctttaatctgcctgtttttcctcttatattttgtatgaaacattgtatctttcttttttttttttttttttgagacagagtctcactctgtcgcccaggctggagtgcaatggcgccatctcacctcactgtaagctccgcctcccgggttcatgccattctcccacctcagcctcccgagtagctgggactacaggcgcctgccaccatgcctggctaattttttgtttcgtatttttagtacagacggggtttcaccgtgttagccaggatggtctcgatctcctgacctcgtggtccgcccgcctaggcctcccaaagtactgggattacaggcgtgagccaccgcgcccggctggaacattgtatcttttacctgctaacgtgcccgtatttttctgtgagtcactgatatgactgacagtgagtttggagtttcctgtctgcgtgccaagtgtctttcagtgagccagggacaaagatatgccacaccatagcagcctttattccaagcacacctcacaccaagctagggggcacttttatatttctgtttattttctgtttattttgtggaagtctcctatggccacatggctcgaaatgttacagtgtgtgacagtggtgggaaatgtgtaggttatcctcattcatacctggggttattgtgaattcttccttcactcactgcccctccctcctccccctgctccctcctatcctgctccaaaaaacacccttggttatgtccctgaatcttctaaaaaccactgtccacctgatgaagcataaacttttgatcttgacagtgtaccaggccacctttatagccacatctctgttgtattgccacaccctccctgcagaacgaggctgggttctggtattcccccacaatgcctcttcttttttgttcagtttctttgccatttgacacatggcttcttctctccatctccctggaaggcacttagccattctcatgcttcatcacagacctttccccaccacccctctggaagctcctccatggagctgagctgtccagtgtacatggtaaatcacctgctaagatctctgaaggtctcgtgaaccaccagcttcttgataaaggaaaccccatcttaatcatctttgtgtcccagctgcccagtgtgggattgccactcagtaggcagcaataagtgttgcatggatctggaacaaaatttagcttcaagaggtctttgaaatcacaaaagtattttgaagcctagaaaatgtacatttgactgtttttttctagagttctgcacactaagagcaatgctgtcattggacctgggtaactcaaagcttttccttcataacttaatctataaaatctgttttccatgaagcagtgtgcactgtgctgacgttggtgtcacctgtgactgcagtgatgctgatccagttgtcaggctggcttcatctggggataccctggggacttccagagaaattcagagaggcccaggagagaaaagacagggctgttaattgaaggatggcatttgtttgttctttctgttcaatgaaaatgagtcagcaaggtagagaggtagaagggtagcttagaatcatcagaggtgttttgttttctcttttttggagtttaaaaaaacatagaaatattgtggagaggctactacgatctggaattactaaatggaaagttatcaagttactgtagcaaagtacataatgaggtcttcctgggtatccagaattctgtatctgaatattacaggcagtagaattaaggaaaatgggtagacttaacacactaaaaatgcccaccttcccattagagatgcccagttacttcctttcattaaatgcgaggtgtgactgatggggtgggttgtatgtgactcatgcaggagcagaaaaagaagcaagaactggagggaattgacatcatgttctaagacattgcttctaagttctaccatgcgtgtgaatcccctggaatctggttaaagtgcaggttctgatttgggaggtctgagctggagcctgaggctctgtttctgaccagctcctgggagatgtcgatgctgcctgtcttcagaccacatcatgtagcagtactttgtgatgtgtgcctgtattactccgttttcacgctgctaaaaagatattacctgagaccaggtaatttataaacaaaagaggtttaattgactcacagtcctgtatagctgaggaggcctcaggaaacttacagtcatgacagaaggcaaaggggaagcaaggcacgtcttaacatggcagctggagagagaagaacacaggaaaaactgccatttttaaaaccatcagatctcatgagaactccctcactatcaagagaacagcatgggaaaagctgcccccatgatccagtcacctaccaccaggccccttctcagcacttggggattacaattcgagatgagatttgggtggggttgctgagccaaaacaaaccacatcattgccatactatattgtacttcaaatgttatctgagaaacggctctgcagggtcacctaatgatagaaaccagagtctatgtttaggagtcatgatatggaagaggggagtcattggagccacatacctgggttcagctccaggctgcgctgtgcagtgagtaccctagtgctggatactaccccaaatggggataacagtgcagctatgacaggggcttcgtcagtttttaaaaatttagagataatttttactaggtgcccagtatagtcagcattctataaacaatagttgactattttaaggaaatcattgaaagatcttaccctgatacttaagaaatcaagtgtgttgttgtgtataatatcccaaataactgaatcttaaaatagacatgagtgaccagtgttcagagaattagttgtttgttagtttcttcagtaagtattgacttaaggccaccatgtgctaggcaccaggtgttaatggttaggagggagttggaatctaatgttctgttactgagattcttaggaatttgaagaaaacacaagagaacatttaagcctgaagtgcatctaggcccattgcaagttgcatttttaagtaagtatttatttatttatatctaaaaccattgcttttcaaaacaatgggaatttacagatcttgggtgtgtggttgtttggaacaaatgagctaaggtcatgtgttagccttagccccactaagcagtctagcatattcacaaagattgttttatatattttatttcagtcaactattgttccagattgtaggaaaacgggttaggaaatataacaatatatttttttggattaatgaaagaaaagggttgaaaatgagtatttctcattcaaagtagattatacaacaggtaagtttggggcactatttttctattaatgtgaaaagctcagaaataagagctcacccaaattagaaaaactttgtttctggaatgaaaactattcagagttcaccaattttaaggaataagaacaaggaacactaaattgtattcagtaaacatgaacactgatacagagccgtgcagacagagtgccttctctgttttctttctgtgacactgtgaggatggaatggccctaaataagaccagttgctaggtggcacttttctagtactagatggcaaaatgctatccagcagactacacactggctttccagagacctcctaggctttaacattgggcagatatcaacatcaaaaagagaaataacaggtactggttcttttaggaggaaatttcattgtaggtgcgggagtggaccaggataggttagcaaaacctcaaaccatactgtggcatatgcttcacttctaggttccatccaattaaaagaactgattggttgttggggtgggtagaggagcttcaaaggaaaggagtcccttgtgacctgtggagacagtccccgggcagcaagagcaggagtagaagaggggtgcccgatggtatatgaggggatggcagaagtctggtagcctgggcgtgtggagtttggctcagccatcctcagtcctggtaacccaacagcagccccagacccttctggatttggacatttcattttccaacatgtgagtttattttctaaataaatggctatgttctcatgagattctgaaggccttatagtcatattaaatgtgtgtttatgacaaatggttgatttatattttataaaaataagacactgatttccacattcttctcattttcccccttcctgttttgtaatggttatattatgtctacatcatcagagcataaaattttattactacacgttattctgtcctcttcattcctgttgtttagttttggttctaaaggtcaaaataaggctcacactgtttatgctgtaacttctccaatgatttttttggttattaaaagcctattctctagcatatcactcaagaaggactcacaggaataggatttcattggttatcatgtgtttataatgtcagtttggctcactgcactgcattgtctgctggtgtatattattgctatcaaaaagaatgactccattctgattttgtttcacagcttggatttattcatttgaaagtggggactaaataccctggggatttttcccatttttctttcaatccaattgtcttgaccatccggggtcagttttcccaggtgtgtggtgtgtcctttcaatatgtgggccgaactcttcattcacttcaggaaagttttgagctgtagttgatagcatttcttttccagtgctttgtttttcttctgggactcagagggcttggatcttctccactgtctttattattttctgtcagatccttttaactctttgtttctgtttggtaaattttatctttctcctttccatcccagtttctcttactattctctctgtggtgcctatttgctctagtcttccttctaaactagtttctgtttctgaaatttttccttatgtttctaattacttcctgtgctgtcagctgtgttttatgtgcgtgctctctggtcatctcatgtctgagcttccctaattctgatttatgttgttgtgtcatagcgtctattattgttcatttctcttttttttttttttttttttttgagacagagtctcgctctttcacccaggctggagtgcagtggcgcaatctcggctcactgcaagttccgcctcccgggttcatgccattctcctgcctcagcctcccgagtagctgggactacaggcgcccgccaccacgcccggctaattttttgtatttttagtagagacggggtttcaccgtgttagccaggatggtcttgatctcctgacctcgtgatccgcccgcctcggcctcccaaagtgctgggattacaagcgagagccaccgcgcccggctggtttttctggttcttttaggaggaagtttcattgtaggagtgaaagtggaccaaaatagttttctaatttaatgactctagaattctctattctttgtaaccacaaaatattaaaacatgcatcctcaccacatccccaggactttctgagatctgtccctctttttccttcatttaaagtttcattcccttttttttgcccaaggtgcccattctgcttagttgaggctcttacttcccgtggttccttctcagtgcaggactctctcctgctgtgagggagttctcatcagctccacccagccctccctagagccctgcccttgtgctgctgtagtctcctggcaagtcctctcggagttccacctgttttcacatcttcactgagttcttcattccgggaggcaggcagggggacttcccctttgagatttttgggagatttctgagttcttggctcttgggccttatcttctcactttccctgatagcacgggggtctcagtgtgctctgaggtgttttgaggttttgtagggtactttgtcatctggttgtgtgaaagctgttgcccatggagtttttttccttttggcttccttttctaagactatgtaaaatactcaatttgcaggttattgaagcaaacctagatggagaattgaatttgaaaatagaaactgaattagtatgtgttacaactcattttaaagatcttggaaatcctccattaggtaagttttctagtgggttatattttgctttggataagttaattgtttcagataacctacctgttgaggtctcttcatgtaaaaaggttgaaattcagttgactttgtttcatgcttgggtgaagaacaaaggaattgagactggactatgtatccctgtggtgtagtggggcagttagccaccagggggagaagctgtgccaccaagtagctgacagatctgtgcagggtctccatcctctgtagaattcggatcaagttacataacctccaagatcccttccagctattcaattcctgtcctactcctaaagatttctatttctcacctggcatggattcagaaaggtagatacatttgttcttatattctcctccttcagttacttccatatgtatgaaattagtgtagcagatgcaaaactgtttcacttgatcacatttcttatctcatacaaggtaataagggacgatagagtcagttcagcaagtggggagagaggggacggttggacagtttggtgagttataagccaagagggggttagaatcatggctggaaagtggcagctgcacagtagcaggggctgcctgagcaggaaagcaggtaaaggaccaggggagaaacacctggggatgatgagaaaatcattttatgatacataagtgtgccagaaccaataaaatcggccctagtcacatttaagttactacgagtctgcttgaatataaacacagattttagcatagagttggaaggaatttttactttctagttaagagcatcctgctccagcagagtgaaatccatacggttatgcctttgataatattgtgtaaagcgattcattctgatgtcactcattttgtttcttttaataaacataaggtgggacttatctttggtactttctcagaggtagaaaggatgttttctttttttttttaattccactccagaatgacaggccttgtattagttaatgtatatattttcactcttaaaatacatagtaagtacaaataaataaaattttctttgacctgaagagggagattgagttatatttcaagtcccctgtaaataaagatgccttggaaattatcatagtattttaaatagttaggacctaatgcttaatgaatgacaacatttacaagttgcaatatttcttcaggatgctaaaatcagtgctaaagtgaatcatttatttaagtaaaatgcattgagtatctccaggtttcctgttacgtgggaagatgttgtatttaaatgcattcctatcattttagcctctgaaagcacccatgaggacagaaacgtggaacacatggctgaagtgcacatagatattaggaagctcctacagtttcttgctggacaacaagtaaatcccacaaaggccttatgcagtgagtgtgcttctctgttttgtttttcatattctttcatattctaaatactgcagtcaactctagtctaacagattgcatatagtctcataaatccaaaaaaaaaaaaaaaagctcaattatgtggactttaacttcctagaacagtggggttttttaaattttcctagattcagaagtacctaaggtggcagcagagaaacaacccctgggcactctgttagggcctgaaacctgcagccacactggttggtaggtgggttgtgtgctgcctcagttggccagcacacctggagatgccatcgggagaatgggtgcagatcatcccaccttctccatggtcatctaatttgacctgctcagagtgccagacacggtttggcttggatttaagttttcccttgtgatgtcttgtttcctttctgtggctatgctggcctgcattcgctgccccatatctgtcccttggctgctggttgttaacagttgcctcttgattctggctgggccccatcttgtgaggtcacacacctgctccagcactcttcatctactgaccacacatgagaaaggcattacctgccaagagcttttcaaggcatttttgtcaccttactactgaaatcacagcaacctaaaagcgactgcatcctggatttgaagttccacgttttgtagcatagctcccaggctgagctgagagggaggttgagccaacactgcacctcatccccttcagatctgcagtgtgctgtagagaaggaacagaagattctaggtggcaatgtcaaggaccagcccttttgaatgagagacatgaagagaatcagaagagaccatgggaggggcaatgggtgtttgggaattggggaaggtgtcacacagttggagtgatgggcacagaaggagatatcgccagagaagcagctctgagggtagagatggagaagctagactaggccagatcatggggagttttggggtgaggtacctgtgctgcattttaaggaactttgacatggacgatgtcatatttctagggctgagcatagtgggagctgtgtggcagtgcagggtccttaaaggtgcttctgagaacctcgatgtgcatggagatcgcctgaaggtcatgtaaagggactccttattcatagtttgggctgggcctcatggctgcacttctcccaagctcctgtacaatgcccagacccttggtcctgacaagcacagtgtgaatggtgagagagtgaaatacccctcctgtctgcagagtgtggaaacacagggtgtggggggcccctgcgctgcacaacatcagtctttgaacttggtattttggggactttctgaatccaaggctgttgaggaacatggaagagttcttatcaaaggtggttgactaagccaagtgtcttcccaacattcactttggtgtctccacgtgtagcagagaaaggaagaccagcaaattgtgatgtagcaaaaattttttttaaaacaccgtgggttgaacttctcataccttcttaacttcccaaagccccttttctgtctctgttagtctccttcaggtgtcggctcaattgtcccctcctctagctaggtcctgccaccctcagtctctgcctctcctgtgcccttgcacacctctcctaaagaatgtttgtctcctgcttgtcctttctggtcctttccccaacctcccatctcctgggattggcctctctgcagcctgctcacacatggtttcttgtcactcactcatatctgctggagagctatcctcggctgctgtgctgagctccccgagctctcggtggttgtcacactgtgtgctcctgcccaccctcatgtgctctttacttccctgcttggttgcatgcctgatgccttggattttagccatcacccatggccctcacgggattggcaggaccgttgagatgcagggatccatcccatgtagcagtgtgtgacacagcctgccccaggtgttgggggatcctggctcttggctcttctcagcacagttcctccactcactggtgaggagctgctcttcgctgcagaaggatgctcatgtgggtgaatgtggtttgccaggaagccagcctgctgggtgttttgccaagggcttgggccgcttcacttttcctctcctcgcacagggagccgccagtgctggggccgtgatgtagcctcagctgtggcagtgagagtgagagactgtggtctctgcagctgcctcagggaagacagatgcctaaaacaggaggtgcaggctgggaaggctgttctgaaaaagtagagatcaaaatgtgtgtgctgcactaggtctctaaaatcatggcttttctcttcccagatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaa

SEQ ID NO: 14390 - DNA, 352 bp, Homo sapiens
ccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagacctttattaaaagagctttctggattttgagcatactttcactggctgtgatttataagaatttgtggtttgtggagtactgtcctaaatgccagggtaaaataaggcagtcccatgccttacctcgcctggctcagggcctcacatccttttggtacgcacatcttttctcttctcccttgttctgctctcccgc

SEQ ID NO: 14391 - DNA, 1306 bp, Homo sapiens
gaaacaaaatgaaatgcaaacatgctttgaaagagcacagtcttgtcctgtccctctgcatcccctctcctcatttctaatgaaaaaaatagtcttccctttccctggttccttcaacagtctcttccttaggttatttttttcctctctcctttcctactccatccagacttccccctgcctaatcttaaagagatgaattggaagaatatgcagtcgtgtcagaaggatgccattgtcagttcacacaggcagacactaataggataaagtattatctgacttcctttaagtccagaaattaagtcttcttgcaatggcaatagattataacttataaccactgtggctggcaggctgcagaaacaggctgttagtatctgaggcctcagctccatttctgggcctattgtgagggatgcactcagcattcctccaaacacagctgcatgatccagggaactggcacttggctcctggatggaactgcctctgtggagagctgcctataactcattcagttcacctgccgtgggagaagctgtctgaatggtcttaatgaacctggatgagtgggcaggtaaagggaggaagccagggtcttgaagactgggaagaagtagcccgaggcaaggaaaccaaactttgcacagggaacacttagtgtgtgaaagctcttctcagtcatccttgctgactcattgagcaggtagtaacttatctagtgactaaatcagcaccagcttagagacacagggaaatgagggttgagaccttaaaggaactgtaaaagagactacaaattaaggagttgccctggagaggaaatatcatgagaaatgttaggaagaaagagccatcattcttcaaaatggagggcctcatgcaggatttcctaggtcctgttatggcagatgagtgtactcaaatggggaatatgggacaggaaacctgatacaataattaattgaagggtatttttttattagtggggctataagaaggtaggtgggggctgggtacagtggctgacgcctgtaatcccagcactttgtgagcccaaggtgggcggattgcctgaggtcgggagtttcagaccagcctggccagcatggtgaaaccccgtctctactaaaaatacaaaaattagccaggcgtggtggtgcgcacctgtaatcccagcaactcgggaagctgacgccaggagaatcgcttgaacccgggaggcggaggttgcagtgagccgagatcacaccactgcactccagcctgggcaacagagcaagactctctctcaaaaaaaaaa

SEQ ID NO: 14392 - DNA, 105 bp, Homo sapiens; identical to SEQ ID NO: 7608

SEQ ID NO: 14393 - DNA, 229 bp, Homo sapiens
ttcttttagaatgtttctattgggacttcacttgaaaccatcatgaagaagacaaattctaattaaatgtatgtgataaaattatagccagggccactctgttcccaagagaggatttgagatgggaggaagaggggacaatttcctagctttctggaccccagtttcagggtagacccctgagtcaacctgggctgccagagctttccctctgagggtccccttgctt

SEQ ID NO: 14394 - DNA, 425 bp, Homo sapiens
aggtaggagggtatgaaagaaacaagtagatcaagtactgtttctttggcatcctataattgatttaaactgtagtaattactctagtaatgttcctgagtgtacagaatgaacaaacctgaaagcctaagtactatcttggtccgtctagctcccacacctagcttgagagtagcctctcatatcaatgcttccctgctatcctttcaaaactctttttgatgggataagtgggcaaagatcatgccatcgtctcaaatgctaacttcctttgacaagacagtttctcccagggatatcccccacaggcctaggccaaatctctgactcactgcaaaggtccatgtacactgaactgatagacatcactatttttattggaaaacacaatttatataacactcttcctctggaataatactctt

SEQ ID NO: 14395 - DNA, 160 bp, Homo sapiens; identical to SEQ ID NO: 7770

SEQ ID NO: 14396 - DNA, 2051 bp, Homo sapiens
caggagcagggaagtacagtcctttctatgtgtctgcaaggaggactcacatctttggtgagcagcactgatgcctgctgcaacctggcatcccctttcctgtctcctttctttcctggtctgtgcagtagtagggtgtattagtccatttttgcactgcaataaaggcatacctgagattgggtaatttataaagaaaagaggtttaattggcttatggttctgcaggctgtacaggtttctgcttctggagaggcctcaggaaacttacaatcatggcagaaggtgaaggggaaacaggcacatctccacatggctggcaagaaaagggaagagcaaagggagaggtgctacacacttttaaacaaccagatctcatgagaactctatcatgagaacagtaagggggaagtctgcccccatgattcagtcgccttccaccaggcccctcctccaacactggggatttgggtggggacacagagccaaaccatatcataggggataggatccttcttatctggtttctttgctaccgtaattaatccatccttataggttcaattctaaaccctgaagacattagtatttcccattgcccttgggatacaaactatttcccttggaccataaggctctctccttatcagacaccaccctcccatgtatgccagcctctctcatactccaggaggtaaaaagctctcacttctgcctggaataatcatgacccctggccacccctctcagttgccaggccactctctctggcctttgaaactgtactcgcatgtcctggcctatccacccaaactaaagcatgcactgcctgttcctttcctttgaccacttatcacaatttatttatttatttatttttgtacatttgcttaatgtctttttccctccctggactgttggttcaccgtggttttcgcagggcctggtgcatagcaggggctcagtcatattttttggatgaatgaacaaaccctgaagatgctacatctgactctatatcttcattttatccttttcgtatttcctattacctctaatttctcttccctgcacccatttctatttatttcatcccagtttacctcctgctgccagattaattttcctaatgcacaggctctatcatatcatgagtttctcattgctacatatgactaatttgccaatatttttgcacatcagaatgtgtatcactttgaggctggttctgtgtttgttttagtttaggaaaagctgttcagattgtctgtaaatccgtatggggatctttgcataggattttaaagcagccacacatcttgtacaaaatgtataagattaattttctatgttaggaccatttgttttcaccaattccatagagctccaatgtgtaaaagaagacactgatctaactcttgtgttaaatatttagtaactcatttatctggaagaaagcaaaacaaaacaaaaatacaaggaataaaaatcactgggagtgcttttcattcactgaataatgagttttgcaaggagcacgtggatggtgacattatatcttttacatctttattttctgtttcttttttgactccttatcagtgaatttatcttattttatacttttactttctatttctttcttgactctttgttggtgaattggtagcaagagacttactgtctgatcagaactttgaatcttcctgcctctctttctttgaggttgacagggataaagataattaagatagcgcttgggtgtgatgacactggaagacaggctgggtcagggcctgtagtagagacttcccccctctattgaatgttaatctgaaagtgaatctgaaagcagatggtcatgaactacccagggtctccattaagcccatgaagtttattttaaaactcttaaaatagattgagattcaaattgagattcatgtctattttttaaacattgtgtcttaacaaagtagatgttcagtcatacagttaggcaaatgttctaaggaaagatgtttaccatgctaagttaaaaaaaaaaaaaa

SEQ ID NO: 14397 - DNA, 2051 bp, Homo sapiens; identical to SEQ ID NO: 14396

SEQ ID NO: 14398 - DNA, 8041 bp, Homo sapiens
aacaggttgtaaaaaatgtatttgttaactctgtgcacaaacgttttatactaaataaatatcaaactacatcttctcaaagatgtttatatatttcttaggtcacttccatatatattatgtatagtgaaaccatttatacaaagcaatgacttaggcaatgcaaccctagtttgttaaaccatttcccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgctgcaaaagggagggaaaaaaatcgagttatgttaaatgcaggcaggtgtagaaaggtgcttttcctgagtgacgaaacaacacaactgaaaaagggagaaagcaccaagataacaaaaagggactataccacattgagacaatgcacagtcaaacagcaccagtggcacagaagcctgctaagggctttaaaaatgattcttggcaaacttcaaaattatttgttactttgccctgccagtctatattgtagtaactcagcaacttcagttaccattttgttgtataatgatggtttatagcaatataaaacaaccctgaatatcaagatagtcaactataatatgctgactttccttcctaaaattatggtataacatttttctaaataaacaggtatgacatttactaataggaacacttttctgcagtaaaatattagaaagttaacaattggcacttacaactgtctttcaaaatatactgcatactagaaaaatgtatgttaatgtgccaccagcacttcatgaaaattttatagagtatggcttaaatatacaaaatatattcagtgctccaagttgactggctaaaatgtcagactttaaaatttgctaaattatttaccaattactgtacagtcttaaagacagtaaaataaaactaaagcaagttattttgaggtacttttggagcctgagtatctttaaaatgtaatcagagtgaagttgctggattacttgtatctgttgctgctgctgttaaaggcagaggaaagctggaatctctgctgaggaaggctttgctcaggtctgttctcggcagagccaagctgagacaacactacagagaggagaaggggaaagcaggccagtcaaaaagtttgaaggctaccagggttagaaaaggacaacatagaaaatgaaataatagaaaagttagcagtatgattaatcttaagtatcaaatcatagacatttcagaataaatttagtatatggtctcctgttagttgggggtaccactgataatggaactttctggacacaaaaagagaagggagtgcattatgtatcaaagcactgaacctctcttctcttgcatctgtataaaatttgatattgatgctattttgtttagaagagtatattatttttgaaataaaaccaacaaagtaggagaagggagatggaagaaatccaaactattgtaacaacaaagctggtagacagacaattgctttaaacaaaagatgctgcaatgaatatcagactactctactaacaataaaggtggtgaactgagactaagcattgtttgttatttttttagctgaatgggaccacagtaatcagttcaacactcattttacatatggggaagtttgaaggccaacatgatttaagtgactcagactcaaagttaagtatggcagtctgtggctaagaacattctcatgatttttttcagactagagttgtttccactaaattatactacagctattttcggaaattcacaattggtctgataaaggtatatgattatataaacttctatttggaaattcactacctctaaattggaactttatatgtaaggataactgacttccaaaataaagattatcattctaaaagacttctaaaggcatcatagtaagcccacagtgataagatgctgacaacacagtcactcattcaatcctcaaactcctatcatagttttcttatacatatggcttactcttttaattaagtgtgaagttagaattatcgtcttcaactgacaggaagttagaattatcgtcttcaactgacaggaagttagaattatcgtcttcaactgacaggataatcattaagagtaatctttagttcaccatttactgctggaagtgttgagaagtaatttaatctttttttttaaatgataaaagtgacttacagaagttatgctattgaccattaagacttaagtcatttatgcaactacaagttaccagaacgagacaaaagattatgcaatctagaaaaattcagtcttaacccaggaaaacaaaaaagttattaattaagataactattggcaaacactgaaaacagctctggtaacctagtaaagtggataattattttgccagtaaactgtaacaaggaaacacaactgtggtaattatgttaagtcaaagctcttaatccactatcaatgaaaaaaaatctcagccatcaatcaatttaatagtttacacattatagctttactttttcctgtttactggttgcaagggaaggaaaagaaaataatttaagcggtgagatcccaaatagattagatatgtttagtaaattcagcatataaagttatgaagatacctaccagctgcctgtgactgcataaaacttcctactccagtaaggttaataacagcagcttgctgagcagataaggcctgttcttgactggttgaaccttgctcagaaccctgaataaaaaaataataaatgacttgtacaagaaagaaaaacaaatttgagctggtgaaaagaaatcagtattttttcctatatgaaagaaagcagtattagactagtcttgtaaaaagaataacaaggaaaatacttcaaaggtatttagaataagcaagaataaatttatggtatttgaacaaagaaaacttcatttttcagtgcatctgtatttattgtttaatgctacctagataacgcctaaggcttttataaagcttcactgaaacaattttttaaagcttaaaacaccctttgtaacataaacatagtgctggaacttttagtcagcagactaagtcaagaaaaggaaaataaaggtatatagattttataggaaaaaataaaatgtcttattttcaaatggcacaactgtctatatggtagaaaaccctaagcaatctccaaacagctcctagaagtagtaagtccagtaagagggcacaaaacaagaccaatatacaaaaatcaacactatatatactagtaatgaacatgtgaaaactgaaataaaaaaaataccattcacaattactcaaaaaaaaagagaaaagcttaggtattaatcttaagtctaagaaaacatatacagggcttgtataccaaaaactacaaaacattgactttggtctagataaggacatatactatgttcatgtactggaagactcacatcataaagatggcagttcttcccccaaactgatcaacaagtttaactcaattcttttagaaatgctggcaaggtttttgtagatatagacaagatgactttaaaatgtatatggaaaggtagagaacctacattagctacaacaattttgaaaaatggtatgggagaaaacactgcccaattttaagacactacaatgaacaagacagtgtggtattggctgaaggagagacacatagattaatgaaacagaacagggaacctagaaatagacccactcaaatagacccaactgacttttaacaaatgtgcagaagtaattcaattcagaaagaatagctgttttttttctttgttgttgttttcttttttttcaacaaatggtattgaaacaattggatactgataggaaaacaaaaacaaacaaaaacaaaacacggacctaagttgcacatcttgtacaaaaattaactgaaaatggatcatggattcaaaataagaaactataaaactgttagaaaaaaaacacaggagaaaatctttgggacctagagctaggtaaagagttccgagacatgaaaactagaggatattccataaagaaaagatactgttaacttggacttcagcaaaattaaaaacttttgctctgcaaaagacatcctttggtaccacctaaaatagtgtctgaagtaacatttcagtatataattgcaagccaaacatttcaaaagttacatttatcttgaggggatctccctggatataaaagattggacaaaagagcacagagctgaaaggaggacacattattgaatttggaacccagttcatgaaatgaacaacagaataaggcagaccacatcaccaccataacggagctatgataaaacaaacaaaaaaactcaaaatgcaaaaaaactacaggtgatatcaatttccccccaaagcactccacaaacctaatgtagactataagccaccaccacaaatggaatattcaaacaaggaggaataatgattaaacaaacatcttgaagaagaaaacaaatactaagaaataaaaggactcaggctaaaactaaaaggatgaaaaaagacgtactaagctaacgttaatcaaaagaaagaaacaagaaatattaccagagataaagaaggtcatttattaatgataaggggtaaattaatcaaggaaataacaatcctaaatgtatatgcacctaacaatatgggctcaaaaaacaacctttagcaaaaggaaaaatagaaattttcagttttggttgaagacttcaacacttctctcagtaactgataaaacatacagaaagaaaaggatatagaagacctgaatgatgccatcaaataccttgatctaatatggaacactcctaacagcagaatatacattttttcagccatatatggagtattcatcaagacagatcacgttctcaagcattaaacaaacctcaacaaacttaaaagaaccaaaaatatgttttcagatcacagtggatttaaactagaaatcaactgcagaaagatatttggaaaattcccaagtatttggaaatcaaacatatctaaataactgatttaagaggaatccataagaaaattctgtggaacaaaatgaaggcacagcatatcaaaatttgtggaaagtggcttaagcagtactgagaaggaaatgtgtaacattaattgtttattttagaaaagaatgacctcaacacaataatctaagcttccacttacgaaactacaaactatcatccaagaaaacattccagaaataaagaagtgactctacacattaaaaggatccacaggaaaaacatggaaaaatcaattctgacacacacaccagtgaaaatattagacaagcattcagggcctctaggcaaactgcttaaataaacttacaagagcaagataattagactggcatcagatttctcaaaaacatataaagcaagtcaacagtaggaagagttcttaataaatttaaaggagacctaaaactagagaacatttataagaaaacaagtgaaaatgcttcaggacattggatttggcaatgatcttcaatatgataccaaaagcacaggcaagaaaagtaaaaagagaaaatgaactacattaaaataaaaaaaaaaaaaacttctgtgcaatggatgcaatcaagagtgaaaagacaacaaatgggagaaaatatctggaaatcaaacatctgatatatgtgtatatgaagaatgaagaactcctacaattcaacaacaaaaattaatctgaaaaaaaaaaaatgggcaagggacccaaacagacttttctccaaagatggtacacaaatggccaacatgcatatgaaaagatgctccacaccactagtcattaaggaaatgccaatcaaaaccacaatgggattatcacctcacacccattaggaaggctgcttaaaaaaaaaaaaaaaaaattccctaaagacccaaccaccaccagaaaataacaagagttggcgaggatttggacaaatcgagatctctgtatgttgttgatgggaattaggtaaaatggtacagccactatggaaaacagtatgatgcttcttaaaaaattaaaaattaccacatgaaccagcaatccaacttctgggtatatatccagaagagttgaagacagggtctcaaagagataattgtacactcacactcacactagcattatttacaatagccgaaaggtggaagatacccaagtatccatcagtggatgaatggataaacaaaatatggtatatacaagtattattcaccatgaaaaaggaaggtgattctgacacatgctataaaatgaatgacccttgaagactttatgccaagtgacataagtcaaacacaaaaggacaaataactatataactgcacttatatgaggtatcttgaatagtcaaactcatactaacataaagtagaatagtggccgaggggaggagttgttatttaccagatatagtttcagttttgcaagatgaaaaagttctataatagaaatctgttgcataacaatgtgaatacacttaacactgctgaattgcacacttaagaagttaaaatggtaagttttggccaggcacggtggctcatgcctgtaatcccagcagtctgggaggctgaggtgggcggatcacgaggtcaggagatcaagactatcctaacatggtgaaactccgtctctactaaaaatacaaaaaaaaaattagtcgggcgtggtggcacatgtctgtagcgacagctactcgggaggctgaggcaggagaatcgcttcaacccaggaggtggaggttgcagtgagccaagattgtgccattgcactccagcctgggcaacagcgcgagactctgtctcaaaaaaaaaaaaaaagttaaaatggtaaattttatgtgtaccttaaaattatttttttaaaagaaaaatcaaagattttatatctagccaagtaatctttaatgtgtttagaatgaaaaaaacagtaagtttttaatgtgcccttcctgaggactctattagaggatgagctttatccaaccaagacctgactgggggaaactgggcaaaaggactaatggtgaatatttcatataatttgtgagatagagaaactctggatttgggactcaggaatcaatatttttttaatttcccagatgactccagtgtacccaaagtttagaaacacttgtacttccttcttctactgtcatttattgcaattcttattcaatttctttccctttggcagtgtacacatttgtttttgtctgtgttcccactgccctacattttatgataatagggatatctttattccaatagcaacaaaatcctaaaaacagaaagataatgatggggtagaaaatacatgagtgataggggcacaaagacctaggtttgaatctctggctctgccactcactgtatggctaagagcaagccatttatctggatctcaatcatctatgcaagatgcaggtgataccatctattcagtatggtatgactgttttattaggaatacacacccaatagctgattgctactattgttaataaaaacagtacaggaaatgtttacactaacaaagcaaatgaagtatgcttggaatataccaaaaaatgttataaattcgatgtaaaagcatatggaaggctagaaaatccatacctgctcccctggctgttgaggactacaagttgtgggctgctgaggttgttgtggtgtaaactgggagagctgctgttgctgctgctgcagagtgttaaaaataagtgaaccacctggaagct

SEQ ID NO: 14399 - DNA, 1465 bp, Homo sapiens
gtttgggtctagttcacatgctcatccctggacctaccactgcgaccgtggtatcaggcactctggctcagccaaggttatatgcccatgtctctgtgtggagtgggtgaaggaggaggaagtaaatgatatgcagtttgatataatagcaaataaccaaggggaatagcaataaccaagggaaagggaagctgaacatttatgatatcctgtagtcaatacccccttaatttattttttgcatggcttaaagccagggctcttatttcccatttggggctttctgtttttttcttgagcttttaatgaacgtttacatttcatcagtttggatttctttgctgccagtgttggatatttgcttttttaaaaacaaaccaaaaaactatcatttaatatatccacctttctacttagactccatcttgaaaagaattatattggcccattggacacattttctcccaagaatttaaactgtgaagtaagggatgaaaggatatgtgtcaatgtttgaaggaccaggcagggctgtggcatgtctttgcctgtgattcctatcaattattgtatcctggtttcagttttctagttctcttttgagtggttcttatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcctttgctgcccaatatgatattactagtcacagatgactgttgaaacctaaatttaaattagaattttaaaaaattaaaattcagtttcttcagtcacatgaagtacatttcaagtgtgcactagcaacatgttgctagtgactatcatattggaaggcacagattgtagaatatttccaccatcaaagaaagttctatcagacaacactgttggagtataaactcaagggtaggcattctgtccttgttattttctgatgtatccacaacacttagaatgggcttagcatgtataggtactcaataaatatttgttgaatgtcgaaatagcatatattgggaggccaaggcgggcagattacctgaggtcgggagttcaagaccagcctgcccaacatggagaaactccgtctctactaaaaatacaaaaaattagccgggcgtggtggtggatgcctgtaatcccagctacttgagaggctgaggcaggagaatcacttgaacccaggaggcggaggttgcggtgagctgagatcacaccattgcactccagcctgggcaacaagagtgaaactccatctctaaaaaaagaaaaaaaaaaaaa

SEQ ID NO: 14400 - DNA, 1466 bp, Homo sapiens
gtttgggtctagttcacatgctcatccctggacctaccactgcgaccgtggtatcaggcactctggctcagccaaggttatatgcccatgtctctgtgtggagtgggtgaaggaggaggaagtaaatgatatgcagtttgatataatagcaaataaccaaggggaatagcaataaccaagggaaagggaagctgaacatttatgatatcctgtagtcaatacccccttaatttattttttgcatggcttaaagccagggctcttatttcccatttggggctttctgtttttttcttgagcttttaatgaacgtttacatttcatcagtttggatttctttgctgccagtgttggatatttgcttttttaaaaacaaaccaaaaaactatcatttaatatatccacctttctacttagactccatcttgaaaagaattatattggcccattggacacattttctcccaagaatttaaactgtgaagtaagggatgaaaggatatgtgtcaatgtttgaaggaccaggcagggctgtggcatgtctttgcctgtgattcctatcaattattgtatcctggtttcagttttctagttctcttttgagtgggttcttatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcctttgctgcccaatatgatattactagtcacagatgactgttgaaacctaaatttaaattagaattttaaaaaattaaaattcagtttcttcagtcacatgaagtacatttcaagtgtgcactagcaacatgttgctagtgactatcatattggaaggcacagattgtagaatatttccaccatcaaagaaagttctatcagacaacactgttggagtataaactcaagggtaggcattctgtccttgttattttctgatgtatccacaacacttagaatgggcttagcatgtataggtactcaataaatatttgttgaatgtcgaaatagcatatattgggaggccaaggcgggcagattacctgaggtcgggagttcaagaccagcctgcccaacatggagaaactccgtctctactaaaaatacaaaaaattagccgggcgtggtggtggatgcctgtaatcccagctacttgagaggctgaggcaggagaatcacttgaacccaggaggcggaggttgcggtgagctgagatcacaccattgcactccagcctgggcaacaagagtgaaactccatctctaaaaaaagaaaaaaaaaaaaa

SEQ ID NO: 14401 - DNA, 102 bp, Homo sapiens; identical to SEQ ID NO: 8430

SEQ ID NO: 14402 - DNA, 331 bp, Homo sapiens
ttccctatactttgaagggaacttgaaatagttccatcttaatgttattccaaagtttccatttaaacttatttatagctacattttctgttgtaacttggccctccagttcacctactatttctgccttcataattacttcaaaagtataaagtacttgatctcatagttaacttttcccccaacttactcatccttcaccctctgatttctccctatcacctactcattaaaacttttaacagtttccactgtagcctctggaatccctattctgataccaataactttttttgcaatctcaacatttttttaatgcctctccccctgc

SEQ ID NO: 14403 - DNA, 331 bp, Homo sapiens; identical to SEQ ID NO: 14402

SEQ ID NO: 14404 - DNA, 88 bp, Homo sapiens
ggaggcggaggttacagtgagccaagattgtgccactgcactccagcctgggtgacagagtgagactctgtcttaaaaaaaaaaaaaa

SEQ ID NO: 14405 - DNA, 2331 bp, Homo sapiens
gaaggtataggggaaaaggtaggggtgagagttatcagtctggttagagctgggctaaacatttagtcttaccatcagtttaaaagcacctggaccagttagttgctgtacaggcaaagtcaaagggagaagcctggcctctctctactcagtcaaggttcatgactttaggagactgcaatgaaccaggcataccaggaaaggaaaaggttaactgaggttgaaaaaaaaactttatgtggcacttttaaacaagcaggttggtttggcttgtgtgactatgatggtgcctgattttgagcagagcaatttgtgttgtgacattttaaaatccattctggcacttggtgatgaatgtgttggctggcagctaagaacttgctagaatgcaagtatgcaagtcttccccatttataatcgacacttcctttccaggaaagagcctttctaatctttgaatcagtggatttatcaatttgcataaaatatgccatcctcaatgaacacatttatcatctaccacttaactttccttctgttaaaaaaaaaaaaaaagcagaatcaccttcctgtgagtcagcagctttaaattcagctgtgctgggtgaagctgttaagggtaggaaggagccatcactagaagggggagaagcaggaataaaatgatcttttctatttccatgattttttatgtttctgtttaaatggttaaatacccaattaggttagatgctaattaaatgtaaaattactgggctgttccaatatgcatgttaaagttgtacttcttggttgtttgtaatttacctaactcttgagagatcatcagagcagcccagctgagtttaaagaaggcttccaactgcccaggatatgcatcagttcctgaacaaaaaaagaacaccccaggatcaacagaagctactatcaaatccttcaaacactacatgcaccacatgctcacatttgtcctatttttgctactatttatccacaaaaaagccaagcctgaactccttcttgaggccaaaacttaaaaatataccaaatgaatcagttcaaaattttacaaatttggtttggcttaatcataactgattcttcatactattgacaccgttgattcttcacactatagataccactcactaaaattacaactcagtcacctcttcccatataccatatttcattaaaatcaatgtaagataagaaatggttaccagatgccatcgtttcagaccaaaccatatgtcaaattttgaataaacctaacaacatctgattggttaagtagcatacctagatttattaaaatcactacactcctttaatgtctgtaggagaacatgcatgcacaagcacacacacgttgtgtgtgcatttatatatatatatatatatatatatatatatatatatgtatatgctactgcaaaattgaagagactttaccaagttctgtcattgacagggacattatatataaagaatatacatactgtaattcacctcatcaagagttaattttatggccgggcacagtggctcacacctgtaatcctaacacttcgggaggcagatcactttgagctcaggagatttgagaccagcctgggcaacgtggcaaaaacccatctctacagaaaaatacaaaaatgagctgggcgtggtgactcccgcctgtagtcccagctgtatacatgggaggctgaggctggaggattgcttgagccaggtagcagaggttgcagtgagccaagattgtaccagtgcactccgccctgggtgacagagcaagaccttgtttcaaaaaaaaaaaaaagagttaattgtaccaggaacatgtggtgtcaaaatttaaaatatgtgaactctttgacccagcaatgctattttcagggatatatcctaagatcatcaccagcaaagtatataaggatgtgcatgcaaaaatattcatcatggctttctttatacaatgaaaaattggaaataaacttctcattaatgggatgctggttaaagaaaatcattactgtaatatgcagccatctaaaagggtaatttatatgtatatatatttacataagaaaaccctcatgtcatattgctgagtaaaaagaaagatgtcaatgagtattcatgatgtgattctatttatccttgcaaatggtggaaattcaattatatggtattttctctcttttctgtttgtttttcatatatgtatatatttcctttgaaatcagaaaaaaatcaagctattttcatcagaggaaaaaaatcattactctgtatttcagtcacactaaaatagtcacccaagaa

SEQ ID NO: 14406 - DNA, 2330 bp, Homo sapiens
gaaggtataggggaaaaggtaggggtgagagttatcagtctggttagagctgggctaaacatttagtcttaccatcagtttaaaagcacctggaccagttagttgctgtacaggcaaagtcaaagggagaagcctggcctctctctactcagtcaaggttcatgactttaggagactgcaatgaaccaggcataccaggaaaggaaaaggttaactgaggttgaaaaaaaaactttatgtggcacttttaaacaagcaggttggtttggcttgtgtgactatgatggtgcctgattttgagcagagcaatttgtgttgtgacattttaaaatccattctggcacttggtgatgaatgtgttggctggcagctaagaacttgctagaatgcaagtatgcaagtcttcaccatttataatcgacacttcctttccaggaaagagcctttctaatctttgaatcagtggatttatcaatttgcataaaatatgccatcctcaatgaacacatttatcatctaccacttaactttccttctgttaaaaaaaaaaaaaaagcagaatcaccttcctgtgagtcagcagctttaaattcagctgtgctgggtgaagctgttaagggtaggaaggagccatcactagaagggggagaagcaggaataaaatgatcttttctatttccatgattttttatgtttctgtttaaatggttaaatacccaattaggttagatgctaattaaatgtaaaattactgggctgttccaatatgcatgttaaagttgtacttcttggttgtttgtaatttacctaactcttgagagatcatcagagcagcccagctgagtttaaagaaggcttccaactgcccaggatatgcatcagttcctgaacaaaaaaagacaccccaggatcaacagaagctactatcaaatccttcaaacactacatgccccacatgctcacatttgtcctatttttgctactatttatccacaaaaaagccaagcctgaactccttcttgaggccaaaacttaaaaatataccaaatgaatcagttcaaaattttacaaatttggtttggcttaatcataactgattcttcatactattgacaccgttgattcttcacactatagataccactcactaaaattacaactcagtcacctcttcccatataccatatttcattaaaatcaatgtaagataagaaatggttaccagatgccatcgtttcagaccaaaccatatgtcaaattttgaataaacctaacaacatctgattggttaagtagcatacctagatttattaaaatcactacactcctttaatgtctgtaggagaacatgcatgcacaagcacacacacgttgtgtgtgcatttatatatatatatatatatatatatatatatatatatgtatatgctactgcaaaattgaagagactttaccaagttctgtcattgacagggacattatatataaagaatatacatactgtaattcacctcatcaagagttaattttatggccgggcacagtggctcacacctgtaatcctaacacttcgggaggcagatcactttgagctcaggagatttgagaccagcctgggcaacgtggcaaaaacccatctctacagaaaaatacaaaaatgagctgggcgtggtgactcccgcctgtagtcccagctgtatacatgggaggctgaggctggaggattgcttgagccaggtagcagaggttgcagtgagccaagattgtaccagtgcactccgccctgggtgacagagcaagaccttgtttcaaaaaaaaaaaaaagagttaattgtaccaggaacatgtggtgtcaaaatttaaaatatgtgaactctttgacccagcaatgctattttcagggatatatcctaagatcatcaccagcaaagtatataaggatgtgcatgcaaaaatattcatcatggctttctttatacaatgaaaaattggaaataaacttctcattaatgggatgctggttaaagaaaatcattactgtaatatgcagccatctaaaagggtaatttatatgtatatatatttacataagaaaaccctcatgtcatattgctgagtaaaaagaaagatgtcaatgagtattcatgatgtgattctatttatccttgcaaatggtggaaattcaattatatggtattttctctcttttctgtttgtttttcatatatgtatatatttcctttgaaatcagaaaaaaatcaagctattttcatcagaggaaaaaaatcattactctgtatttcagtcacactaaaatagtcacccaagaa

SEQ ID NO: 14407 - DNA, 2331 bp, Homo sapiens
gaaggtataggggaaaaggtaggggtgagagttatcagtctggttagagctgggctaaacatttagtcttaccatcagtttaaaagcacctggaccagttagttgctgtacaggcaaagtcaaagggagaagcctggcctctctctactcagtcaaggttcatgactttaggagactgcaatgaaccaggcataccaggaaaggaaaaggttaactgaggttgaaaaaaaaactttatgtggcacttttaaacaagcaggttggtttggcttgtgtgactatgatggtgcctgattttgagcagagcaatttgtgttgtgacattttaaaatccattctggcacttggtgatgaatgtgttggctggcagctaagaacttgctagaatgcaagtatgcaagtcttcaccatttataatcgacacttcctttccaggaaagagcctttctaatctttgaatcagtggatttatcaatttgcataaaatatgccatcctcaatgaacacatttatcatctaccacttaactttccttctgttaaaaaaaaaaaaaaagcagaatcaccttcctgtgagtcagcagctttaaattcagctgtgctgggtgaagctgttaagggtaggaaggagccatcactagaagggggagaagcaggaataaaatgatcttttctatttccatgattttttatgtttctgtttaaatggttaaatacccaattaggttagatgctaattaaatgtaaaattactgggctgttccaatatgcatgttaaagttgtacttcttggttgtttgtaatttacctaactcttgagagatcatcagagcagcccagctgagtttaaagaaggcttccaactgcccaggatatgcatcagttcctgaacaaaaaaagaacaccccaggatcaacagaagctactatcaaatccttcaaacactacatgcaccacatgctcacatttgtcctatttttgctactatttatccacaaaaaagccaagcctgaactccttcttgaggccaaaacttaaaaatataccaaatgaatcagttcaaaattttacaaatttggtttggcttaatcataactgattcttcatactattgacaccgttgattcttcacactatagataccactcactaaaattacaactcagtcacctcttcccatataccatatttcattaaaatcaatgtaagataagaaatggttaccagatgccatcgtttcagaccaaaccatatgtcaaattttgaataaacctaacaacatctgattggttaagtagcatacctagatttattaaaatcactacactcctttaatgtctgtaggagaacatgcatgcacaagcacacacacgttgtgtgtgcatttatatatatatatatatatatatatatatatatatatgtatatgctactgcaaaattgaagagactttaccaagttctgtcattgacagggacattatatataaagaatatacatactgtaattcacctcatcaagagttaattttatggccgggcacagtggctcacacctgtaatcctaacacttcgggaggcagatcactttgagctcaggagatttgagaccagcctgggcaacgtggcaaaaacccatctctacagaaaaatacaaaaatgagctgggcgtggtgactcccgcctgtagtcccagctgtatacatgggaggctgaggctggaggattgcttgagccaggtagcagaggttgcagtgagccaagattgtaccagtgcactccgccctgggtgacagagcaagaccttgtttcaaaaaaaaaaaaaagagttaattgtaccaggaacatgtggtgtcaaaatttaaaatatgtgaactctttgacccagcaatgctattttcagggatatatcctaagatcatcaccagcaaagtatataaggatgtgcatgcaaaaatattcatcatggctttctttatacaatgaaaaattggaaataaacttctcattaatgggatgctggttaaagaaaatcattactgtaatatgcagccatctaaaagggtaatttatatgtatatatatttacataagaaaaccctcatgtcatattgctgagtaaaaagaaagatgtcaatgagtattcatgatgtgattctatttatccttgcaaatggtggaaattcaattatatggtattttctctcttttctgtttgtttttcatatatgtatatatttcctttgaaatcagaaaaaaatcaagctattttcatcagaggaaaaaaatcattactctgtatttcagtcacactaaaatagtcacccaagaa

SEQ ID NO: 14408 - DNA, 171 bp, Homo sapiens
caaacaggagggctagcccaggtttgagctggacactccactgacagttctaaagcagaaaattagggaaggaatagtcaggggcttatcagctatgcagtagcttctagaagtcaacagctggctctgggagggaaaagattgagaaaaacaaaagaaataaataagagc

SEQ ID NO: 14409 - DNA, 171 bp, Homo sapiens; identical to SEQ ID NO: 14408

SEQ ID NO: 14410 - DNA, 171 bp, Homo sapiens; identical to SEQ ID NO: 14408

SEQ ID NO: 14411 - DNA, 12280 bp, Homo sapiens
gatcacaaggtcaggagattgagaccatcctggctaacacagtgaaaccccgtctctactaaaaatacaaaaaaattagccgggcgtggtggcgggcgcctgtagtctcagctactcgggaggctgaggcaggagaatggtgtgaacctgggaggtggagcttgcagtgagccgagatcacgccactgcactccagcctgggcgacagagcgagactccgtctcgaaaaaaaaaaaaatggggaaggaaccatctaggagggaacacaatgagggacgggcccccagctgcagatgtgacagtggtatcagtctgggcatcctcagagggccagtaggtgggcagggctggctgggggcatgtcctgctttatagaagcgcatgtcacaacccccataactgctgctgccctgcccccaggtgacacgcccttcacctcaccaccagaggtggacagctgccaggggatagacagtaacctaccagggtccctagctcaaggcatgggcagtgtggccctgcagatgagggcacacctggctgctcacgacaggtgacgccatgccaccctccacagtgtactgcagtggaggtggcccatgctgggctgaggggtccctggtggggcagggacttcctgtctggggctctccctgccaagctgaagacatggaaatcctctggggtggacgggtgcagctgacgcctcgtccctactgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtggtgagatctcggctcactgcaacctctgcctcctgggttcaagtgattcttgtgcctcagcctcctgagtagctacgactatagctgcgtgccaccacgtccagctaatttttgtattttagcagagactgggtttcaccgtgttgcccagggtggtctcgaactcctgagctcaggcggtctgcccacctcagcctcccaaatcctatcagttttctagtcccagctagttggggactgcaacctgccagtatctcccctggagcccagtgggagggtgggtgaggccacgcctgtcctgcccctgagccacaggccagcgttggtcaaacgcccatgggcggcagccaaggggagagggggctgggctgtggggacccaggaaccttgccccctcctgctgtggggtcggagtgagggtctggcatggggagactgctgtgatcctgctcttccttggcccacggaggcagtgtcccaactaccgcctcccttcactcaaagaaacctggggttcctgggagctgactcctgtgcagaggcagcatggtggggtgaatggtgtcccccaaaaggtacgtccatatcctatcccacatgcttgtgaatatgatatcatttggaaaaagggtctttgccgatcagattaagagataaggagatgaagacatgctggatttagggtgggccccaaagccaaggacttgtgtccttttaagagataaaaggagggctgggtgcagtggctcatacttgtaatcccagcactttgggaggacgaggtgggcagatcacctgaggtcaggagttttcaagaccagcctggccaacgtggtgaaaccccatttctattaaaaatacagaattaacaggatgtgatgtctgtgattccagctacttgggaggctgaggcaggagaatcgcttgaacctggcaggcagaggttgcagtgagccaagatcgcactagtgcactccagcctgggtgacagcgggagactgtcttaaaaaaaaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatacagtggcacaatcttggcttactgcagccttgatctcccaggctcaagtgatcatcccacctcagcctcccgaatagctgggactacaggcacgcatcaccatgcctggctaatttgtatattttttagagatggggttttgcctggccgggcgcagtggctcacacctgtaatcccagcactttgggaggccgaggcgggcggatcacgaggtcaggagatggagaccatcctggctaacacgtgaaaccccatctctactaaaaatacaaaaaaaattagccgggcatggtggcgggtgcctgtagtcccagctactcgggaggctgaggcgggagaatggcatgaacccgggaggcggagcttgcagtgagccaagatcgcaccactgcactccagcctgggcgaaagtgcgagactccgtctcaaaaaaaaaaaaagagagatggggttttgccatgttgcccaggctggtctcaaactcctgggctcaagcgatccgcccagtaattgattttgttgctgttgcttgtttttgagatggtctccctctgtcacccaggctggagtgcagaggtgtgaccacagctcaccgcagcttcaacctcccgggctgaagccatcctcctgcctcagcctcccaagtagttgggactacaggcgccaccaggcccagctgactttcttacttttttgtagaaaaaggggtcctactatgttgcccagggtggtcttgaactcctgggcttaagcgatcctgccttggcctcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggtgagccctcctgcccctctccacccgcactgagccacagcccagagcgtcacagcccagagcgtcacagcccagagcgtctgtggtgctgtcattactcttgttgtctttcctttccatgggggtggcttgctgtcgttcagcccttccctgcagtatgttgccagggaggagggccatggctctctgtgcctcagtttctctctatgcagtgggtggcaggcctctcccacagggtgagggtgggcttcatggagggagagtggaggttgtgcctggagcaacatgttacttgaccagcttgtaactgtgccgtggggctggcggggcctgcacgtggcatcaccaggtcggaggccatggctgggggtccaggactcccctgctgccgtttccaaagcccttgcctcagagttgttcacactgtagttccgttgcccttccctgcgttccatcctccatggagtgagtctctcctgagctctaccttgtggtggccaccctggggggccatagctggccccagtcccaccttcccagggcctgcacgtggtcagacgggcagggtggctcgggcacttagtcgtggggtatgagcatgcagtggagcacaaagcaggggccatccccaggctccggtgggccccaagtggggacaaggcagggatggccaggccagggccctcggccactcagcccctctgtcatctgtccccgccccaggaaggagctgaagagaatgcaggacctggacgaggatgccaccctcacccagctcgccactgcctgggtcagcctggccacggtgagccctaggccatgaggtgggtgggcattgcgggcacctggctgagcagggtctgtgggcacccccacctgtgcgtaggctgctggccactccagtggggctccaggatcaggccgtggcccctgccagcctggcataactcagccttgactccattccgggcttctcacagccaagcgacttggccagagccagagcgaagagatggtgggggcggggacgggttcctgagcctgaggcacaggggtactcgagggtctgggttggcctggcaggccctcctcccctcagggcttcctggggttttctgcgactcagctttgctctccagggtcctggtcgccagccagggacggagttcagtgttcccatagcagcggtggagatgtcctcagctcccaggcctgggcacctccgcccggcaacagcccctctcctggtttctgggacttggcccccttctgagccactcttttgtgtgggcctattaaaatgtgcttcctggctggtcgcagtggctcacgcctgtaatcccagcacttcgggaggccgaggcgggtggatcatgtgaggttgggagttctagaccagcctgaccaacatggagaaaccccatctttaccaaaaatacaaaattagctgggcttggtgccatgcacctgtaaacccagctactcaggaggctgaggcaggagaatcgcttgaacccgggaggtggaggttgcggtgagccaagatcgcgccagtgcactcctgcctgagcaacaagagtgaaactctgagaaagaaaaaaaaatgtgctccccgtccctgcccgccacggggctgaagcctcacccagacagacttccagtgaccgtctagtatggtaggacaggccccggcagacctatcgggtagtttgggctgttttcactgcctgccttggcctcaggctccccctgcaagtgttctgctgttctgagcaagtggacaggtcagggctgctggtcacagagctgactcctcctcctctgacgtgctcagtgacccagtggtccccactcagaccctgagccagccacctgtgcactgaggccttggaagccccagattccacctctgtgtactcagcactccgggagctgggtgggaggtggggcaggaggcggccacgagtctttaggccccatcagcagagtacaagttacgggtagtccccatggcggagtggctgtgccttgaaccgggcacaccagattcgtctctgtgcagtgctggagtcccccccgctaggggagggggctggcgggggaagggccgggcagcaggggcacaggcaatgatgcgggaccctccctgcagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggtaggcacaagcctgtcccagagtggggacggagggaaggccaggcggccagagggtggggtcagggcggacagaaacaagtgtagcagagaccccctgggtgtgcgtgtggccccacagggcttctaaggcccagtcagcagcgagatccacaaagcagggatctcacctgcaaagaaatccagattccggcctcacagaaatggggcatctgggcagcctgggcctcagtggtctgagccgtccttgttgtcacctcagctgcctggcccgggacctgcaagtgggacccctcacctgagtacatactcagtattggagagacactccccgtacttatgtaggggagagtgtgctgtggacaggagctcttcgttgagagagcgctgcctgcccagggtggctgcagtcatctcctgcctgatgtctgcagtcttttcttccttccttccttccttccttccttccttccttccttccttccttccttccttctttcccttccttccttccttcctttccttcctttccttcctttccttcctttcctttccttcctttccttcctttccttcctttcctttcttctttttttttttttttgagatggagtctcactctgtcacccaggctgcagtgcagtggtgtgatctcagctcaatgcaacctccgcctcctgggttcaagtgattcttttgcctcagcctcccaagtagctgggattacaggcggctgccaccacgcctggctaatttttgtatttttagtagagacggggttttgccatgttggtcaggctggtctcaaactcctgacctcaggtgatccacccgcctcagcctcccaaagtgctgggattataggcgtgagccaccacgcctggccatctgcagtctttatgaagagtttatgttatgttaaattaaaaatatatatatattttgtaaagacggggttgttcttgctgtgttgcccaggttggtctcgaactcctggcctcaagtgatcgtcccacctcagcctcccaaagcattaggattataggtgtgagccaccatgcttggtggattttttttttttttttttttgagatggagtcttgctctgtcgcccaggctggagtgcagtggtgtgatctcggctcactgcaagctctgcctcctgggttcatgccattctcctgcctcagcctcccgagtagctgggactacaggcgcccaccaccatgcccagctaattttttgtatttttagtagagatggggttttgctgtgttagccaggatggtctcaatctcctgacctcatgatgctgcccaccttggactcccaaagtactggattacaggcgtgagccactgtgcccagcctggattattatttttataatcagaaaggacatcaaagctttttccattttggagaaacgaattttggggggttttttgtttgttttttgaaacggtatgccaccatgcgtggctaatttttgtattttttgttagaaatggggtctcactgtgttgtccaggttagtcttgaactcctgggctcaaacaattctcaccctccttggccttctaaagtgctgggatgatagacatgcgccagtgcgcccagctgagaaacagttttaatctagtgacaaacactggtgaagccctcctccctgtctgactttccaggggctgagttatcatcagaaagttgtttgcagagcggggctggccaaggggtatcaggctggccccatcacaggccgggtactgctcctcctgagcagggtccatctttagctctgagcagtcagggctagtcaggaactcccagcctgatgtgcaatctcagacaggctgtgtgtccctcgctgccccaggggcaagactggcgccctcctccaccaccctgcccctccctgccacctgagaacacttggatgcatgttgtgttcatggccgcatcctctgggggcttttgttacacctctcaggtgacacgttccgtgactcaccagttagatgactcccttctgtccttgtctcttgaaacaccacctggggctggctggccgtgccccttggccctggtggcctccccgtggctgtggtcaccctgcattcttgctgggttttgggaggcactcaggtccccccacttccctttggagccacctcatggctgctcctgtgagcgcaagctggtgtcccccttcatggtggagactgaggctcagaaaagtccggtctgcaaaaaggtgccctgccatgggccgccgtgggcaggtcgggctctgggcgcatcctcgttggtgtgtctgtgctccaagcagacaccagggctctggctgggtctcctggcctagatgtttcctagggtcctgtgtgctgggagcctagagtgagtgagtcaggcaaggtcccctgccgaggtctccttcaaggctccttgggagctggtgcaggggtggcaggtctgcccatggcctcggggttcgttgtacagcaggagttgaggccatctgggtctgggccccatggctttgagatgtgtgggacaaatacaaccttcccaagtctctgtaaacaaggggtcgtaccccaggctggactacagatggggaaactgaggctcagcgaggcggctggccccttggcaccgtatcatctgagatctccaccttgcagagcggtgggcggtgtcagtcccaccccacctctgaggaggtgaccttgtgtggtgctgcctgaggtgggggtgacgggcaggcatgggggctggagtggctgaccctgcctccccgtgtctgcctgtgtctccaggatagtggctacccagagacgctggtcaacctcatcgtcctgtcccagcacctgggcaagccccctgaggtaagcggcccccagggctccaggccaaccctaatgtccagaccctgggaccccagcctggggtccaggccctaatccctaggcccctgggaaaactctgtatacagtatgcctaccgcagcccacctccctcacaaaccctgtgccccccaacccatcctcacctggggccctgcccgacctgctcccctgaacaccacaatacatcccccaccatgtacggaggccagctccatgccagcgcctctccagggggcaggcccatccctccacccccaccctgaaggttctccgagatcagcccagtcccaaggcagggtgaggagccccctggggtactgtggctctcaccccaatccacccctgtccagcaggtcagagccaccgtggggtccccgtgttcggctcacctgcctccctgcctcccctgcaggtgacaaaccgatacctgtcccagctgaaggatgcccacaggtcccatcccttcatcaaggagtaccaggccaaggtgagtggtggggatggcctgtccccgagaaccaggccagggggcgcctggagctcagcctgggctcacatgcgccctctctctctccctccacctgtctccccacaccctgcccccaccctgtgttgccatgtgtcttgctaaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 14412 - DNA, 181 bp, Homo sapiens; identical to SEQ ID NO: 7550

SEQ ID NO: 14413 - DNA, 295 bp, Homo sapiens; identical to SEQ ID NO: 7552

SEQ ID NO: 14414 - DNA, 319 bp, Homo sapiens; identical to SEQ ID NO: 7553

SEQ ID NO: 14415 - DNA, 316 bp, Homo sapiens; identical to SEQ ID NO: 6716

SEQ ID NO: 14416 - DNA, 286 bp, Homo sapiens; identical to SEQ ID NO: 7557

SEQ ID NO: 14417 - DNA, 300 bp, Homo sapiens; identical to SEQ ID NO: 9955

SEQ ID NO: 14418 - DNA, 316 bp, Homo sapiens; identical to SEQ ID NO: 7560

SEQ ID NO: 14419 - DNA, 283 bp, Homo sapiens; identical to SEQ ID NO: 7561

SEQ ID NO: 14420 - DNA, 170 bp, Homo sapiens; identical to SEQ ID NO: 7565

SEQ ID NO: 14421 - DNA, 109 bp, Homo sapiens; identical to SEQ ID NO: 7566

SEQ ID NO: 14422 - DNA, 300 bp, Homo sapiens; identical to SEQ ID NO: 7568

SEQ ID NO: 14423 - DNA, 184 bp, Homo sapiens; identical to SEQ ID NO: 7572

SEQ ID NO: 14424 - DNA, 147 bp, Homo sapiens; identical to SEQ ID NO: 6794

SEQ ID NO: 14425 - DNA, 169 bp, Homo sapiens; identical to SEQ ID NO: 7578

SEQ ID NO: 14426 - DNA, 131 bp, Homo sapiens; identical to SEQ ID NO: 6213

SEQ ID NO: 14427 - DNA, 227 bp, Homo sapiens; identical to SEQ ID NO: 7587

SEQ ID NO: 14428 - DNA, 235 bp, Homo sapiens; identical to SEQ ID NO: 7589
  misc_feature (230)..(230): n equals a,t,g, or c

SEQ ID NO: 14429 - DNA, 187 bp, Homo sapiens; identical to SEQ ID NO: 7592

SEQ ID NO: 14430 - DNA, 143 bp, Homo sapiens; identical to SEQ ID NO: 7597

SEQ ID NO: 14431 - DNA, 170 bp, Homo sapiens; identical to SEQ ID NO: 7598

SEQ ID NO: 14432 - DNA, 184 bp, Homo sapiens; identical to SEQ ID NO: 7604

SEQ ID NO: 14433 - DNA, 125 bp, Homo sapiens; identical to SEQ ID NO: 7605

SEQ ID NO: 14434 - DNA, 196 bp, Homo sapiens; identical to SEQ ID NO: 7606
  misc_feature (106)..(106): n equals a,t,g, or c

SEQ ID NO: 14435 - DNA, 183 bp, Homo sapiens; identical to SEQ ID NO: 7394

SEQ ID NO: 14436 - DNA, 175 bp, Homo sapiens; identical to SEQ ID NO: 7613

SEQ ID NO: 14437 - DNA, 196 bp, Homo sapiens; identical to SEQ ID NO: 7614

SEQ ID NO: 14438 - DNA, 159 bp, Homo sapiens; identical to SEQ ID NO: 7616

SEQ ID NO: 14439 - DNA, 190 bp, Homo sapiens
ccgtctctactaaaaatacgaaaaattagccaggcgtggtggcaggtgcctgtggtcccagctactcgggaggctgaggcaggagaatggcatgaacccaggaggcggagcttgcagtgagccgagatcatgccactgcactccagcctgggtgacagagtgagaccatctcacaaaaaaaaaaaaaaaa

SEQ ID NO: 14440 - DNA, 219 bp, Homo sapiens; identical to SEQ ID NO: 7618

SEQ ID NO: 14441 - DNA, 154 bp, Homo sapiens; identical to SEQ ID NO: 7620

SEQ ID NO: 14442 - DNA, 169 bp, Homo sapiens; identical to SEQ ID NO: 7623

SEQ ID NO: 14443 - DNA, 207 bp, Homo sapiens; identical to SEQ ID NO: 7625

SEQ ID NO: 14444 - DNA, 230 bp, Homo sapiens; identical to SEQ ID NO: 7626

SEQ ID NO: 14445 - DNA, 189 bp, Homo sapiens; identical to SEQ ID NO: 7630

SEQ ID NO: 14446 - DNA, 207 bp, Homo sapiens; identical to SEQ ID NO: 7631

SEQ ID NO: 14447 - DNA, 150 bp, Homo sapiens; identical to SEQ ID NO: 7633
  misc_feature (21)..(21): n equals a,t,g, or c

SEQ ID NO: 14448 - DNA, 162 bp, Homo sapiens; identical to SEQ ID NO: 6214

SEQ ID NO: 14449 - DNA, 301 bp, Homo sapiens; identical to SEQ ID NO: 7637
  misc_feature (98)..(98): n equals a,t,g, or c

SEQ ID NO: 14450 - DNA, 1092 bp, Homo sapiens
cacaactctgggaggaagagtatcccaacctttgggtgaacaaactgaatctcaaatattttataatttatccaagctggtaagtggcagagctgggatttgaacccaggtctgtcttgttctaaatgccctgctttttttcactgcatcttcctcttgtgccatgtggttaaagataggcttcctttcaatattcagtttagttctattttacaaaacttcactaagcacctaccatgtgccatactctctggtgggcccagaggacaaagagatgtattagacctgacccctgacttgaggaactccatgtttaatggaaaagtagatgactgaccactaagatccaggatttaggtttctttcttgctacccatagaaatagcaatattgccttgtggatccctggaccattttcctcatgggaaggatatctttggcttggattaaaactgcaaagcataggataagaagtcagttctcaggtcactggttcacttagcttttttgtggctagaattacagccaagaccaggtccagccaggctgggcacaggtgtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggtgatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagactccgtctcaaaaaaaaaaaaaaaaagaaagtgac

SEQ ID NO: 14451 - DNA, 267 bp, Homo sapiens; identical to SEQ ID NO: 7644

SEQ ID NO: 14452 - DNA, 246 bp, Homo sapiens; identical to SEQ ID NO: 10003

SEQ ID NO: 14453 - DNA, 193 bp, Homo sapiens; identical to SEQ ID NO: 7396

SEQ ID NO: 14454 - DNA, 3991 bp, Homo sapiens; identical to SEQ ID NO: 7650

SEQ ID NO: 14455 - DNA, 177 bp, Homo sapiens; identical to SEQ ID NO: 7651

SEQ ID NO: 14456 - DNA, 140 bp, Homo sapiens; identical to SEQ ID NO: 6216

SEQ ID NO: 14457 - DNA, 187 bp, Homo sapiens; identical to SEQ ID NO: 7657

SEQ ID NO: 14458 - DNA, 246 bp, Homo sapiens; identical to SEQ ID NO: 7658

SEQ ID NO: 14459 - DNA, 153 bp, Homo sapiens; identical to SEQ ID NO: 6795

SEQ ID NO: 14460 - DNA, 211 bp, Homo sapiens; identical to SEQ ID NO: 8070

SEQ ID NO: 14461 - DNA, 202 bp, Homo sapiens; identical to SEQ ID NO: 7667

SEQ ID NO: 14462 - DNA, 203 bp, Homo sapiens; identical to SEQ ID NO: 7398

SEQ ID NO: 14463 - DNA, 166 bp, Homo sapiens; identical to SEQ ID NO: 7670

SEQ ID NO: 14464 - DNA, 280 bp, Homo sapiens; identical to SEQ ID NO: 7673

SEQ ID NO: 14465 - DNA, 190 bp, Homo sapiens; identical to SEQ ID NO: 7674

SEQ ID NO: 14466 - DNA, 2364 bp, Homo sapiens; identical to SEQ ID NO: 6735

SEQ ID NO: 14467 - DNA, 1367 bp, Homo sapiens; identical to SEQ ID NO: 10738

SEQ ID NO: 14468 - DNA, 261 bp, Homo sapiens; identical to SEQ ID NO: 7678

SEQ ID NO: 14469 - DNA, 312 bp, Homo sapiens; identical to SEQ ID NO: 7681

SEQ ID NO: 14470 - DNA, 158 bp, Homo sapiens; identical to SEQ ID NO: 7682

SEQ ID NO: 14471 - DNA, 237 bp, Homo sapiens; identical to SEQ ID NO: 7684

SEQ ID NO: 14472 - DNA, 191 bp, Homo sapiens; identical to SEQ ID NO: 7689

SEQ ID NO: 14473 - DNA, 193 bp, Homo sapiens; identical to SEQ ID NO: 7690

SEQ ID NO: 14474 - DNA, 195 bp, Homo sapiens; identical to SEQ ID NO: 7691

SEQ ID NO: 14475 - DNA, 297 bp, Homo sapiens; identical to SEQ ID NO: 7695

SEQ ID NO: 14476 - DNA, 182 bp, Homo sapiens; identical to SEQ ID NO: 7696

SEQ ID NO: 14477 - DNA, 323 bp, Homo sapiens; identical to SEQ ID NO: 7699

SEQ ID NO: 14478 - DNA, 183 bp, Homo sapiens; identical to SEQ ID NO: 7707

SEQ ID NO: 14479 - DNA, 136 bp, Homo sapiens; identical to SEQ ID NO: 6219

SEQ ID NO: 14480 - DNA, 279 bp, Homo sapiens; identical to SEQ ID NO: 8074

SEQ ID NO: 14481 - DNA, 243 bp, Homo sapiens; identical to SEQ ID NO: 7716

SEQ ID NO: 14482 - DNA, 202 bp, Homo sapiens; identical to SEQ ID NO: 7718

SEQ ID NO: 14483 - DNA, 192 bp, Homo sapiens; identical to SEQ ID NO: 7720

SEQ ID NO: 14484 - DNA, 153 bp, Homo sapiens; identical to SEQ ID NO: 7724

SEQ ID NO: 14485 - DNA, 300 bp, Homo sapiens; identical to SEQ ID NO: 6744

SEQ ID NO: 14486 - DNA, 150 bp, Homo sapiens; identical to SEQ ID NO: 7399

SEQ ID NO: 14487 - DNA, 322 bp, Homo sapiens; identical to SEQ ID NO: 6747

SEQ ID NO: 14488 - DNA, 142 bp, Homo sapiens; identical to SEQ ID NO: 7400

SEQ ID NO: 14489 - DNA, 181 bp, Homo sapiens; identical to SEQ ID NO: 7737

SEQ ID NO: 14490 - DNA, 123 bp, Homo sapiens; identical to SEQ ID NO: 6220

SEQ ID NO: 14491 - DNA, 270 bp, Homo sapiens; identical to SEQ ID NO: 6749

SEQ ID NO: 14492 - DNA, 237 bp, Homo sapiens; identical to SEQ ID NO: 7744

SEQ ID NO: 14493 - DNA, 214 bp, Homo sapiens; identical to SEQ ID NO: 7748

SEQ ID NO: 14494 - DNA, 154 bp, Homo sapiens; identical to SEQ ID NO: 7755

SEQ ID NO: 14495 - DNA, 243 bp, Homo sapiens; identical to SEQ ID NO: 10081

SEQ ID NO: 14496 - DNA, 307 bp, Homo sapiens; identical to SEQ ID NO: 7758

SEQ ID NO: 14497 - DNA, 166 bp, Homo sapiens; identical to SEQ ID NO: 7759

SEQ ID NO: 14498 - DNA, 142 bp, Homo sapiens; identical to SEQ ID NO: 7402

SEQ ID NO: 14499 - DNA, 131 bp, Homo sapiens; identical to SEQ ID NO: 7764

SEQ ID NO: 14500 - DNA, 214 bp, Homo sapiens; identical to SEQ ID NO: 7765

SEQ ID NO: 14501 - DNA, 268 bp, Homo sapiens; identical to SEQ ID NO: 7767

SEQ ID NO: 14502 - DNA, 906 bp, Homo sapiens; identical to SEQ ID NO: 7771

SEQ ID NO: 14503 - DNA, 368 bp, Homo sapiens; identical to SEQ ID NO: 6222

SEQ ID NO: 14504 - DNA, 278 bp, Homo sapiens
gacgacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggcca

SEQ ID NO: 14505 - DNA, 131 bp, Homo sapiens; identical to SEQ ID NO: 10092

SEQ ID NO: 14506 - DNA, 2925 bp, Homo sapiens; identical to SEQ ID NO: 6223

SEQ ID NO: 14507 - DNA, 4706 bp, Homo sapiens; identical to SEQ ID NO: 7776

SEQ ID NO: 14508 - DNA, 1548 bp, Homo sapiens; identical to SEQ ID NO: 7779

SEQ ID NO: 14509 - DNA, 4704 bp, Homo sapiens; identical to SEQ ID NO: 7404

SEQ ID NO: 14510 - DNA, 3517 bp, Homo sapiens
gaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggaatttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcattcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacagtgtcagaccaaattgcttgtttctttttcttggactactttaatttggatcctttgggtttggagaaagggaatgtgaaagctgtcattacagacaacaggtttcagtgatgaggaggacaacactgcctttcaaactttttaccgatctcttagattttaagaactcttgaattgtgtggtatctaataaaagggaaggtaagatggataatcactttctcatttgggttctgaattggagactcagtttttatgagacacatcttttatgccacgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 14511 - DNA, 3539 bp, Homo sapiens
gaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaatggtgcatggaattaggaacatgttgcgacttgttttgtctactgcatcctaaagatcagcccataatagagagaggtgtaggaaaacggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaatccctgcgtgtctgttggcataatagtttacaaatggttttttcagtcctatccaaatttattgaaccaacaaaaataattacttctgtcctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtgtttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 14512 - DNA, 596 bp, Homo sapiens
gaaatggcccgtttgcccagtgtggctttccccactgccatgatgccccagcagacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggagctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaat

SEQ ID NO: 14513 - DNA, 1341 bp, Homo sapiens
ggattaattacaaaagtgtgtgtgcaatgtcagggaccgacacacagttgtgcagaaacccgtgttagcatcagcagagctatttccacttgtgggcccaaaaggccaggagaagtcactaggacctggaagcagagtcctgtagagcaggtccccaaccccccgggccacagactggataccttagcctgtggggaaccgttaggaaccgggctgcacagcaggaggtgagcagcaggcaagcaagcattactgcctgagctccacctcctgtcagatcagcagtggcgttagattctcataggagcatgaaccctattgtgaactgcatatgtgaaggatctaggttgcgcactccttatgataatctaatgtctgatgatctgagatggaagagtttcatccccaaaccattccctggccccagtccatggaaatattgtcttccacgaaactggttcctggtgccaaaaaggttggagactgctgctgtagagcaggctacctcaagaagagctgtgacttccttcaaagcacacagtgggccttaagccctcccagaaagaagctagggaatgaatgaataccctgatctcatttgcttcactgggctctctgtttgccgactccaagtggaagcctgcaaatatgggagctgttgattataatctatcaatgtaagtcagctttctggctgggagcttggtggagaaggaaagagagtgaatctgaaggggcaaacatattacctaaaataacattctccttccaactatatttctgagaaatttccactggtaacctgttattgatgtgtctaggcagaaagcataaagttaaaaaaaagtacgtatttagaatcctgacttctttttctgatctagtagtgtgtttcttcaccactttggctttgagcactcaaagtgcagacagtcatcagcagtgggatggataaattctggtacattcattgaaatgaatgctacgcataaatgaaaaagagcaacttgcaacaacacgtagtatattcatcaaaataatgttgagcaaaataagccagacacaagtaatacattctgtatgattccattacataagtttaggaaaaaccaaccaatagtaaatagataatctgaacagtggctactttttgggagaaaggtctagactgaagtgagagaaagaagaatctttctggagtctgaaagtatcttgacctgggtggtgactacatgagtgtatatatacgtaaaatttcatgtaaaatttaacttaagatttatgcatttgacttatgtaaattatacttcaataaaatgtttctacaataacctacagaaa

SEQ ID NO: 14514 - DNA, 597 bp, Homo sapiens
gaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaat

SEQ ID NO: 14515 - DNA, 977 bp, Homo sapiens
cagcaaacagggaccacggctaatgatgtgctttttaggggcaggatgcatagaggttaagacttggactatggcctggattgcctgggttcaaatcctgcctctactctatcacttcaggcaggcaggtccttaggctctttgggccttctcatttcctcttctgaaaaggaaattcacctcgtgctgtagtaagtccgtgaattgatatctgtaaggcacttagtaagcactgtatactgtttgactatttgtcttagtctgctcaggctgccataacaagataccatagactggccaggggaggtggctcacacctgtaatcctggtactttgggaggccaaggcaggtggaccactggaggtcatgagttcaagagcagcctggccaacataccaaaattccgtctctagtaaaaatacaaaaattagctgggcgtggtggtgtgcgcctgttaattccagctactcggcagtctgaggcaggagaattgcttgaaccagggaagcggaggttgcagtaagcagagatggcaccactgtactccagcctgggtgacagagcaagactctgtctcaaaaaaaaaagataccatagactgggtggcttgaacaacagaaatgtattttctcacagttctggagactagaagtcccagataaaagtccagcatggtgctgggtgcagtggctcacacctggaatcccagcactttgggaggccaaggcgggcagattatgaggtcaggagttcaagaccagcctggccaacatgatgacaccccgtctgtactaaaaatacaaaaattgcctgggcatggtggcacatgcctgtaatcccagctactcaggaggctgaggcaggagaatcacttgaacccaggaggcagaggatgcagtgagccaagatcgcgccattgccctctagcctgggcgacagagcgagactccgtctcaaaaaaaaaaaaaaaaaaaaa

SEQ ID NO: 14516 - DNA, 137 bp, Homo sapiens
actttgggaggccgaggcgggcagatcatgaggtcaggagatcgagaccatcctggccaacatggtgaaaccccgtctctactaaaaatacaaaaattagctgggtgtggtggcgcacgcctatagtcccagctact

SEQ ID NO: 14517 - DNA, 5659 bp, Homo sapiens
  misc_feature (4939)..(4939): n equals a,t,g, or c
gttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcccacgtccggaggcctagccgtcgcttacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaaggtcggctgcggcgtgggctcgcctctgccaggcgggggtagattgaacgtaaagcctatgttaggggagtgtggggagggaattcacttacggaaaaagcttcctatccaaacaacgggaaaggcataacgttatggccaggtggtaggaaggcataaattttgacctagcttgatttcggggaaaagagcacccaaggaaataatccggaaatggtcagagggagcgtgatacatatgaagatttttaaatacgtgcaggacataattagtcttttgttatttgagaaggggtctcgaaattgttgaaagcatctgaacgttgaacagatgaggaatagttgaagttgcttttggtataatagttcagacgagtcactttggccagtcttgttttgtaatgtgtaaaatgaaggaattggactagattatttccccagttgaccatctttaagtcctaattagaatgtttatttatttatattttgagtcagagtctaactcaggctgtagtgcagtgacgtaattatggctaactgcagccttgacttcctgggctcaagctattctaccacgtcagcctccagagtaactgggactacaggcatgcgccacctgtgcaccacacttggcgactttattctattttatattttagcagagacagggtctcattatgtggccctggctggtctcaaagtcctggcctcaaatgatcctttcgcctccacttccctaatcactgggattacaggcaagagccaccactccgcagcctatgttaattatttgatccgtcaataaaatgtaaactccatgaatgcagagatttttgtctcttgttcacagttacattaccagcgccttgtagttacctaatacttgaatgaatgaatcctgtaagaatctttctaacttttagtagtctgtatttcttatgacatgttggatatgtctttaaagatactgtgggctatccgaatacatggaaattgttgcaaagaagcagaaaaaactagtatgtcctaggctattactattataagaaaagattaaagtggccgggcgtggtggctcatgcctgtaatcccaacactttgggaggtcgaggcgggtggatcacttgaggtcaggagttcgagacgagcctggccaacatggtgaaactccgtctctactagaaatacaaaaattagctaggtgtggtggtgcgcgcctgtaatcccagctacttgggaagcggaggcagaagaatcggttgaacccaggaggcagaggttgcagtgagattggatcgtgacactgcactccagtctgggcatcagagtgaggccctgtctcaaaaaaaaaaaaaaaattaggccgtgcgtggtggttcacacctgtaatcccagcactttgggagtccgaggcgggtggatcacctgaggtcaggagctggagaccagccatggtcaccatagtgaaacctcgtctcaactaaaaatacaaaaaattagccggaggtggtcgcgggtgcctgtaatcccagctactcggaaggctgaggcaagagaatcgcttgagtctgggaggtggaggttgcagtgagctgagattgcaccattgcactccagcctgggcaacaagagcgaagctccatctcaaaaaaaaaaaaattgaagagagaaaatgatgtaaataatttgaaatgaaaatcttgaggtccattttaatatgtaagttattttaagttgacaatttccaaaactggttggaattgggaacttgatgtttttttcttttctttcacagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggtgggaatttaggcagcatttcccttccatgggtggattttatgagaaaagccagacgtttgtaagttccttaagtgtaggaattgtctttgattttagaacccactgtgctgttaatagacaatgggttttaaagccacatttggccgttgagttactgccttaggccagcaccaacaagtactgtacaaattgtgtttcttcccaaggaggagacttacaacagtccacttgactcactgtaaaacaaccacttttccctttgaatatttcatcccagtgacacttcctactaatcttgtcttgatcttagttaacaaatcaaaaatctcgcatagctgtgtgttcttttacgtgatgtttgccattacccatctttctgatgtgtgtgggctttctagtctaatgagcataggtgtgtatactcttgtatttccggtgtgcttgaaactgctccatccagttttctataatagtaccatttttcctccctgaagcttcagtaaaccatttagtcttgataacaagataataattccactttatttgcatctttatttaggaatctttctggttgtaattggaattttgttaaaactgttggctttcagcttttaaatattttcacttttggctgggaacggaggctcatgcctataatcccagcacattgggaggctgaagtgaagggattgcttgaacccagaagtttgagaccaggctgggcaacatagcgcaaccctgtctttactaaaaatatttatttaaattcttcttttttggaggtggagtctcgctctgttatccaggctccaccgcccgggttcaagcgattctcctgcctcagcctcccgagtagctgggattacaggtgcctgctaccacgcctggctaatttttgtatttttagtagggacggggtttcaccatattggccaggctggtctcaaacgcctgacctcaagtgattcacccttctcggcttcccaaagtgttggaattacaggcgtgagccaccatgtttggcctaaaatattttttaagtaaatgaagatttaaatgttttcacttcccatgttaatagttggaaactttaattagcatctggtgctagttccattttccattaacctcaaagaggatggatactcttcattgtctaggcataagtatgattttctttctcagcaatgttgaatgttttgcctttgcaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggtaggtaatttgtccaatttacatctgcttaattcacagtggaattcctggatcctgtagaacttagggtaatctgtgtttaataaattagagaagactttgttgaaatttctctagaattaactcctaacaactgggccggaggtttctagtcatttttatgagtaattttctgaattttcttcctttagaaggtataggccaggcacagtggctcacgcttgtaatcccagcactttgggaggccaagacgggtggatcacctgatgtcaggagtttgaggccagcctggccaacatggcaaaaccccatctgtactaaaaatacaaaaaattagctgggtgtggtggcaggcacctgtaatcccagctactcaggaggctgaggcaggagaattgcttgaacccgggaggcggaggttgcagtgagccaagatcctgccactgcattccagcctgggcaactgggtgtctccagtgggagacactgtctcaaatttaaaagaaaaaaaaaaaaaagaaggtataaatcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtngtccctactctgtagaatctgggactgggcaaatgtttgtgtggcctccttaaactagctgttatgttatgattttattctttgtgagttaattagaataaagtcattttcgtccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgta

SEQ ID NO: 14518 - DNA, 1644 bp, Homo sapiens
ctgggagtggtggcacatgcatgtaatcccagctactcgggaggctgaggcaggagaattgcttgaacccgggaggcggaggttgcagtgagccaagatcctgccactgcattccagcctgggcaacatggtgtctccagtgggaaacactgtctcaaatttaaaagaaaaaaaaaaaaaaagaaggtataaatcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtcctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaaaccattcttaatatatgcagttcccctgaa

SEQ ID NO: 14519 - DNA, 289 bp, Homo sapiens
atttctttcattcagttcatactacgcgtccacactgtgcctccaaaaatatttgcccttataactgaatgctcagaaaggctaagaaatctgcccaaggtcccctggcaatccagccagagatgtgagtcactcttaaggttggatttaatacaaatgtttgaaggacggagcgacaggccagctgccctagggaagcaaaatgctaagtgctctgatgcgaggaccggaggacaaggttcgcggatgaaccacaggaacttccgggttttaaagatcctggcgccaa

SEQ ID NO: 14520 - DNA, 655 bp, Homo sapiens
tttttctgagtttcagagccctgcatcactgccaggtgagtgaaatgctggtgattgagggaattagccagttgctgtctcgcctcctatcagctgtgttcctggagtgcctaaacattcagttcctgaaagaggctccctttcagaaagagggtctcagcacagttcactcctggccagttccccggcatattccctcctgggtttatagaagacacttttgctaattttcctggaggctcgggacctctgtgagtctgtagtgttaatgctcagatgtccctcgtgtccaggtgtagtggtgattcaaataaattgaatcaaagaaaaatgacgaaatgtaagcgtgactggccaggcctactccctggtaggagtcattgctacaaggagaaaggtgtggaataatcctctaggtgcactggccttttgccctaaagtcagaaaggattttgtgatgcattcattgattgtccagttggcgctccaattccctgagtttggtgtccatggattcagccaatcgaggattgagaatatttgaagtctgtgcaataaagtgagatccctacaaaaaataaatcagccaggtgcagtagcatgcacctgtagtcccagccactagggaggccgaggtgggatcacagaagcccag

SEQ ID NO: 14521 - DNA, 656 bp, Homo sapiens
tttttctgagtttcagagccctgcatcactgccaggtgagtgaaatgctggtgattgagggaattagccagttgctgtctcgcctcctatcagctgtgttcctggagtgcctaaacattcagttcctgaaagaggctccctttcagaaagagggtctcagcacagttcactcctggccagttccccggcatattccctcctgggtttatagaagacacttttgctaattttcctggaggctcgggacctctgtgagtctgtagtgttaatgctcagatgtccctcgtgtccaggtgtagtggtgattcaaataaattgaatcaaagaaaaatgacgaaatgtaagcgtgactggccaggcctactccctggtaggagtcattgctacaaggagaaaggtgtggaataatcctctaggtgcactggccttttgccctaaagtcagaaaggattttgtgatgcattcattgattgtccagttggcgctccaattccctgagtttggtgtccatggattcagccaatcgaggattgagaatatttgaagtctgtgcaataaagtgagatccctacaaaaaataactcagccagggtgcagtagcatgcacctgtagtcccagccactagggaggccgaggtgggatcacagaagcccag

SEQ ID NO: 14522 - DNA, 1208 bp, Homo sapiens
aggaaagtctgaaattagcaagttatgaaattaaaaaatcatcgagatttaaaaaatatttttgggcttcatcttcatatgtgaagaaagtacgtgtgccactcacctgaaggaatgtctgcataagtattgcagtttctttaacccaacaaggtgtgattgcatttattcacatggacagaataacaaacccaaaaactttatcattcgttgatgagaagtgttagtcatttatttgaatgtcagttttaagctactgataacatgattgattagcaacggaaacattttagaagataccacgcatttgtttaattcaaatggtcaactgtcaggatacatcgctctcttattccactctcaccacaatctaactttaaaacattctcatcaccctaaaaagcaaccttggcactccccatcctccccttccatcgcccgtgccccaggcagcccctggttactttctgtctctgaggacttgcctgtcctgggcgttccacgtaaatgagtcagacctatgcagtccctgctggcctccttcactggcatatactcttttactggttcattcgtattgtagtgtatatcagtacctcatttctgtttattgccaaataatattccatcgtgtggatacaccacactttatttatccattcataaggtgatggacatgggttgtttctactttttgcctactacgactaatgctgctgtgagtattcagggttctagccaatgcagttaggcaagagcaagaaggtggcgtccacattgtaaaggagagcaaaactctctctgtatgtgtgacatggtcatgtccgtaggaaatcctcaggagtcacccagccctctattaattaaaggggtttggtaagattgtaggacgcaagatcaacacacaagaatgaaattgtatttctgtatgctaacaacgaaccatccagagatagaattaagaaaacaattgtatttacagtgcatcaaaaaatatttcattgtgttaagacggcaacaattctagcttcttttatctataggttctgtgtaatacctactaaaatcccagctacctttgcataaattggcaagctgattctgaaattcacatggagatactagggattcagcatggctacaacaatcttgaaaaacaaacaaagttagaggacttgcaactcgtgatttcttctttaaaaaaaaaa

SEQ ID NO: 14523 - DNA, 1498 bp, Homo sapiens
atcagaaaccttttgtcaaaagacattttctgtctatatagctacataccatagccgagtctgctgtgaatctctttgacgtgacggcactcttactctctggctgcattcattcctcccttttccaaagcttccaatttgggggcatattaatttctgttgtattaaaatgacaaaagttgtagaaatcatcagtgtttgaaatcatggagagcatttgaggtaagatttgaaaaataattttgtattacagactctacattatctactactgcataagaggtgaaggaaagtctgaaattagcaagttatgaaattaaaaaatcatcgagatttaaaaaatatttttgggcttcatcttcatatgtgaagaaagtacgtgtgccactcacctgaaggaatgtctgcataagtattgcagtttctttaacccaacaaggtgtgattgcatttattcacatggacagaataacaaacccaaaaactttatcattcgttgatgagaagtgttagtcatttatttgaatgtcagttttaagctactgataacatgattgattagcaacggaaacattttagaagataccacgcatttgtttaattcaaatggtcaactgtcaggatacatcgctctcttattccactctcaccacaatctaactttaaaacattctcatcaccctaaaaagcaaccttggcactccccatcctccccttccatcgcccgtgccccaggcagcccctggttactttctgtctctgaggacttgcctgtcctgggcgttccacgtaaatgagtcagacctatgcagtccctgctggcctccttcactggcatatactcttttactggttcattcgtattgtagtgtatatcagtacctcatttctgtttattgccaaataatattccatcgtgtggatacaccacactttatttatccattcataaggtgatggacatgggttgtttctactttttgcctactacgactaatgctgctgtgagtattcagggttctagccaatgcagttaggcaagagcaagaaggtggcgtccacattgtaaaggagagcaaaactctctctgtatgtgtgacatggtcatgtccgtaggaaatcctcaggagtcacccagccctctattaattaaaggggtttggtaagattgtaggacgcaagatcaacacacaagaatgaaattgtatttctgtatgctaacaacgaaccatccagagatagaattaagaaaacaattgtatttacagtgcatcaaaaaatatttcattgtgttaagacggcaacaattctagcttcttttatctataggttctgtgtaatacctactaaaatcccagctacctttgcataaattggcaagctgattctgaaattcacatggagatactagggattcagcatggctacaacaatcttgaaaaacaaacaaagttagaggacttgcaactcgtgatttcttctttaaaaaaaaaaaaaa

SEQ ID NO: 14524 - DNA, 738 bp, Homo sapiens
ttcgtgaatcgcgaatgctgctgtctgatcgttcctctggaagttttgtctcagaggagtacccggctgtgtgaggtgtcagtctgcccctgcttggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgtcctgcccccagaggtggagcctacagaggcaggcaggcctccttgagctgtggtgggctccacccagttggagcttcctggctgctttgtttacctaagcaagcctgggcaatggcgggcgcccctcccccagccttgctgccgccttgcagtttgatctcagactgctgtgctagcaatcagcgagactctgtggggtaggaccctccgagccaggtgcgggatataatctcatggtgcgcccttttttaagcccgtcagaaaagtgcagtattcgggtgggagtgacccgattttccaggtgctgtctgtcacccctttctttgactaggaaagggaactccctgacccttgctcttcccgagtgaggcaatgcctcgccctgcttcggctcgcgcaacatgcgctgcacccactgtcctgggcccactgtctggcactccctagtgagatgaacccggta

SEQ ID NO: 14525 - DNA, 1155 bp, Homo sapiens
tccgtccagctttgttctgttgctggtgcggaactgtgttcctttggaggaggagaggcgctctgctttttaaagtttgcagtttttctgctctgttttttccccatctttgtggttttgtctacttttggtctttgatgatggtgatgtacagattagtttttggtgtggatgtcctttctgtttgttagttttccttctgacagacaggaccctcaactgcaggtctgttggagcttgctggaggtccactccaaaccctgtttgtctgggtattagcagcagtgggtgcagaatagcggattttcgtgaatcgcgaatgctgctgtctgatcgttcctctggaagttttgtctcagaggagtacccggctgtgtgaggtgtcagtctgcccctgcttggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgtcctgcccccagaggtggagcctacagaggcaggcaggcctccttgagctgtggtgggctccacccagttggagcttcctggctgctttgtttacctaagcaagcctgggcaatggcgggcgcccctcccccagccttgctgccgccttgcagtttgatctcagactgctgtgctagcaatcagcgagactctgtggggtaggaccctccgagccaggtgcgggatataatctcatggtgcgcccttttttaagcccgtcagaaaagtgcagtattcgggtgggagtgacccgattttccaggtgctgtctgtcacccctttctttgactaggaaagggaactccctgacccttgctcttcccgagtgaggcaatgcctcgccctgcttcggctcgcgcaacatgcgctgcacccactgtcctgggcccactgtctggcactccctagtgagatgaacccggtacctcagatggaaatgcagaaatcacccatcttctgccttgctcacgctgggagctgtagactggagctgttcctattcggctgtcttggctgccccccttccatttcttgta

SEQ ID NO: 14526 - DNA, 628 bp, Homo sapiens
gagcctccacagcctgcaggtatccagacgacgttctgcacacagagactcagactcccaccagggcctcacgccccactgcctctccgggatgcctgcgtgtggctcactcccaccacgggcacatcagccctggtgcccagctggccttctgcagagcctggtgctggagcagcttctcgaattctctgctgcctcctccccacagccttccagggcctcagagctgctgccaggccagcacctccttgggcccgtgttgaggccccacggggctgggctcatgtgggagctgatcttggccgggtgatccctcactgctctggacaaaagggagccatgggccgggcatggtggctcacgcctgtaatcccagcactttgggaggccaaggtgggcggatcacctgaggtcggagtttgagaccagcctggctaatgtggtgaaaccccgtctctattaaaaatacaaaaattagccgggtgttgtggtgggtgcctgtagtcccagctactcgggaggctgagacaggagaatggcgtgaacccgggaggtggaggttgcagtgagccaagattgtcccatccagcctgggtgacggaggaagactctgtctccaaaaaaaaaa

SEQ ID NO: 14527 - DNA, 816 bp, Homo sapiens
cagttcaactcccgtgctctccaaagctagtcccatcattacacgcgccatttaggacgctccaggccatctcggtcaccaggggcctggcggtcaccgtgtttcctcatgaggctcagtgggtgctgtgtgtctgtgggtgccggtgatgaaataaatgtaaggcatcagagcattttaatagatgggagcctccacagcctgcaggtatccagacgacgttctgcacacagagactcagactcccaccagggcctcacgccccactgcctctccgggatgcctgcgtgtggctcactcccgccacgggcacatcagccctggtgcccagctggccttctgcagagcctggtgctggagcagcttctcgaattctctgctgcctcctccccacagccttccagggcctcagagctgctgccaggccagcacctccttgggcccgtgttgaggccccacggggctgggctcatgtgggagctgatcttggccgggtgatccctcactgctctggacaaaagggagccatgggccgggcatggtggctcacgcctgtaatcccagcactttgggaggccaaggtgggcggatcacctgaggtcggagtttgagaccagcctggctaatgtggtgaaaccccgtctctattaaaaatacaaaaattagccgggtgttgtggtgggtgcctgtagtcccagctactcgggaggctgagacaggagaatggcgtgaacccgggaggtggaggttgcagtgagccaagattgtcccatccagcctgggtgacggaggaagactctgtctccaaaaaaaaaa

SEQ ID NO: 14528 - DNA, 677 bp, Homo sapiens
gctgcagtccctgtctcttcagaccctctgtgctcttaggagactgtcgttgttctctcctttttaaaccatcctgtgccttttaacagaataaacggcaaggggtccccactgaggtcgaataatgctggaggagggccgtgggtccaggcatggtgggggctgcctcctggttgttgatgagcagaaattcaggccggtttgacggcaggcacgtgagggaggttgctgtgtgtcagtggccctgtgtccctggcactgtgtccgaacctgacagccgccgctgtgtcactgggcacctgccctgcgcaccctcccctgtgacgggcactctcacagctttcctggcgaggctgagggaaaaacatggcaaacaactcgcacatgactttgcgtttttggccttgtcatataataaaagtaatttgtgggcctaaaataaatcagggctggggatcagatgcctccaatctggcctttaattgcaggcgtgacatggcttgcctcggcgagtctgctcctaattaaagtgggctggcggtgtatgaagttcgcacggatcctcagggtgctgacccagccccggttccggagggccagtgtgacgacacctcgtggcccaggagagcagggcgggccacccatggccaccgtgccaggaatggggtcttctggct

SEQ ID NO: 14529 - DNA, 425 bp, Homo sapiens
gcccgcttccaggctgtggcatgccaggcgagtcaccggcatcctgtccctgcccaccgctttaagaaactgttagttctgtttgaaatgtcatcactgggcgtgaattcccatcttcagataatcccgccaggcggtgtttggatgaggagtttattcaggctgtgggggtctgtgcgtgcccgcgggtccctcccactgcagccggcgaggctggccctgacccagagtcgcccgcccacccagtctacgtaggcattagaggtttgggttctgagctcagggcctggtttccatggcaaatttctctcccttcggcgaggctgctgccggcggggttcagctccccagaagggagatggcagcaaatctgcgggaggagagtcttcgttatctttgcttaaaaattgggcagcgcatggctt

SEQ ID NO: 14530 - DNA, 425 bp, Homo sapiens; identical to SEQ ID NO: 14529

SEQ ID NO: 14531 - DNA, 677 bp, Homo sapiens
gctgcagtccctgtctcttcagaccctctgtgctcttaggagactgtcgttgttctctcctttttaaaccatcctgtgccttttaacagaataaacggcaaggggtccccactgaggtcgaataatgctggaggagggccgtgggtccaggcatggtgggggctgcctcctggttgttgatgagcagaaattcaggccggtttgacggcaggcacgtgagggaggttgctgtgtgtcagtggccctgtgtccctggcactgtgtccgaacctgacagccgccgctgtgtcactgggcacctgccctgcgcaccctcccctgtgacgggcactctcacagctttcctggcgaggctgagggaaaaacatggcaaacaactcgcacatgactttgcgtttttggccttgtcatataataaaagtaatttgtgggcctaaaataaatcagggctggggatcagatgcctccaatctggcctttaattgcaggcgtgacatggcttgcctcggcgagtctgctcctaattaaagtgggctggcggtgtatgaagttcgcatggatcctcagggtgctgacccagccccggttccggagggccagtgtgacgacacctcgtggcccaggagagcagggcgggccacccatggccaccgtgccaggaatggggtcttctggct

SEQ ID NO: 14532 - DNA, 1014 bp, Homo sapiens
cacaactatagattacagttctagatcttagtggtctgaattatgtggaaaaggtatacaccacacttcgaggactggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaagtgaacggaaatgtttgtagagggaaataaagtataatgtgccatttcacagatcattgaattagaacagaagactcccctttttaaaatgtttgctgctgcaactgtgtggtacaatgaaggaaaattcacgcttgcagatgctttgttcaagggcatttgtagtttccatgtgtgttcaactgacttctaaaggcctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctctacaaaaattaaaaattagctggacatgatggtgtgcctgtagtcccagctgcttgggaggctgaggtggaaggaccacttgagtctgggaggtcaaggctgcagggaactatggtcacaccactgcactccagcctaggtgacagagcaaaaccctatctcaaaaaaaaaaaaaaaaaaaaaaaa

SEQ ID NO: 14533 - DNA, 1014 bp, Homo sapiens; identical to SEQ ID NO: 14532

SEQ ID NO: 14534 - DNA, 105 bp, Homo sapiens
aggctgaggtaggagaatcgcttgaacccgggaggcagaggttgcagtgagctgagatcgcaccattgcactccagcctgggcaacaagagtgaaactctgtctc

SEQ ID NO: 14535 - DNA, 279 bp, Homo sapiens
agaagaaatacaaatagccaataaacttactagtaatcacaagaaccgtaatgagaaaaacaagaaaataggacatttgcccatctgatagcaaaaatttaagagtgattatatccagttttcaatataaaatgataatccaatttaataaaatataccatagaaatgataagcacaaacaacttatgacccagccaatccacttccagaattttattctggaatacacatgaggccaggtgcagtggttcatgcctgtaatcccaacactttgggaga

SEQ ID NO: 14536 - DNA, 279 bp, Homo sapiens; identical to SEQ ID NO: 14535

SEQ ID NO: 14537 - DNA, 418 bp, Homo sapiens
gctttacaaatctgacagtgttttgagaaaggaacacagaacattgccagaaggagcctatgattgaggtgaacctcacgaatgtctttgaaaacctgactctaaccaaaaagtatgagggagggagagttctggctgctgtagacgacactacctcatgaaagtgacttagaaatcagcctggagtccctagagcaggtctaacaatgagggaggcaagattaaaatggagaaagaagcctgctaggggttgcatgagctggttgagttcaccaagccagattttccaacgcaacattttatgtgtgtgtgcttgtattcgtttatctggggagagaatgaataactttccatcagattttcagaggaacctgtgaacccttcccctgcctactccctgctcccaattaaaaactac

SEQ ID NO: 14538 - DNA, 13371 bp, Homo sapiens
agttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaaggtaataatatagtgtcaaatacttaaatgtctttcctatgtgctagtcactgttttaagcactttagctgtattgatttattatgttttattccacactctaccatagaacctacagcaaaatctgtcttagatactaattttttaatataagcttttaatgtattgttaacaatttggtcacattatattactgggttttgtgtttctaaattattttagtagttataactggataacttattttctttttcttctgtattatagatcttagtgtttttgtatcggtcaaaaatttatctgactgaataattagaaataatttagggaagaatcacttaaaataacagtggcaaaaatactgtagaatgtcttgattggccatataatgttactcgtttttcctaaatgtttagtcattttttactgttcctttaactacagattacatttttttgtttgtttgtttttactgtcttcacaaatgcttccaaatatggctgcttccaaccctgagtttaacccaggaacaatactgcaaactgctcaattcagtagtgagtgggctatatgcatacctactcatcaaagctattatttaaagaattattatttttttagcactcttagcatttcaagataatgcatgcactcagttcccaaagtgtattattgcttcttgaaactcctctttgatctgctgaaagtaatgatggctaccatcttaaacagaccctaaggttgagagtaaacatataaatttgaaagctgtttattgatatattgattatcagtggtcacttacctatcagtgaactttggtagtgacacatacagactggtatttataacgtgcaggcaaaataagtactgtgaccttgaaagatttttttttttttttgagacttgcactcaaaagattttttttttgagtcttgcactgtcacccaggctagagtgcagtggcaagatctcggctcagcctcccaagtagctgggattacaggcacccactaccacacccagctaatttttatgtttttagtagagacagggtttcgatatgtttgccaggctggtctcaaattcctggcctcaagtgatctgcccacctaggcctcccaaagtgctgggattacagacgtgagctaccacacctggccttgaaagattattttctatttctgacccattatataccacccatactgtagtgcttgtattttctctcacacatactgtattttttaacttgagagagtgtatttggtagactagatgacagtctttttgagacagagttttgctcttgttgcccaggctgaagtgcagtggcgcaatcttggctcactgcaacctccgcctcctgggttcaaggaattctcctgcctcatcctccctagtagttgggaatacaggcatgcgccaccatgcctggctaattttttgtatttttagtagagacagggtttcactgtgttagccaggatggtctggatctcctgacctcgtgatccgcccacctcggcctcccaaagggctgggattacaggcgtgagccaccacgcccagccaggtgacagtcttaaactatttgcttaaattacagaattatcttttcttgatttatctttgttttatttgaaggatctttagaagataatgaatagtataatattactttaccagtttaccataattttaaattgctaatgtcttttgttcctcagcttcagaatttgaaatataactgcccagctgtaactatataagaaaatatgtagataagaaattttcattttgagtttttagtatatcaagcatgtggtattgtacctaggaagttttattgtttttttgttgttgttttgttcttttgcttttttttttaaaaaaaaccaaaaaaccattactggaaataggatttggtgagggccagaaagatgtatgatgtgatatgcttattaaaagttactactacatgacgagtctgttggtggctcatgcctgtaatcccagcattttgggaggctgaggcaggaagttcacttgagcccaggagttcataaccagtctgggtgacatagtgacacccaatctctacaaaagataaaaaactagccgggcatggtggtgcacacttgtggtcccagctactctggaggctgaggtaggaagatcacttgagcctaggagctcaaggctgcagtgagccataattgcgtcccggcactctgcctgggcaacagagggagaccctgtctcaaaaaaaaaaaaaaaaaaagagtaagatatagctaaaagcaccctactatgtgccagctcatttctgtttgtttggttttgtatttcaaagcaaaaatcactatacatgtgatttctggtttctttttactcaaccttaactatgttattggtttgattttaaccgaagattttcctgtgtgtaaatgttctttgttgcagcataactacaagtagtctcatttttaatgtgttgccaaatatttaccatatggattatttactttatagattgtttatttaccttatagattattatttcctttgtagatcattatcttatagagccattggcaccagaattagagttttggggggttttttggtcctagaacttgttagtgaattacagtcacacatttcttaatggcagggatatgttctaagaaaaatatgtcattaggcagttttgccattgtgtgaatgtcatagaatgtatttacacaaacctagatggtatagtatatactacacatctgggccatacaatgtaacctcttgctcctaggctacaaacttgtatagcatattaccatactcaacaattgtaacacaatggtaagtatttgtgtatctaaacatagaaaaggtacagtaaaaatatggtatcataatcttacaggaccgctgttgtttatgcggtcttgttgatgaaaacatcattatgtagtgcatgactataatggaatacttttgtattgatacctaaaaaaaacttttgcataagttactgcctgacaaaaattcttagctatcaattctaatttcagtcttgacttaggcctcctgaaagatttctcagattcaactacagaaggccccatacagtgtatgatttgcaaaagcctatataaaatacgcaatatctggttggataacctctaaaacaaaagtttttaacaggaaaggcagcccaaagttccagggagaaacatgcatttgcaaagcaagggccacgcttagaaaataaaagtttttaagggtgagaactgccatgagagaaaaagcacagagtttctggaagataactgatagaaaaagggctgaactgccctttttgttttgttcatttaatttaagaaatggtaccagaatgccaagattatgtgtcccttccttccaacagccatctcttcactgtgcgctgttagtagcaagagggcaaggagacatatggtgatgactcagactaccactactggataaggtagatagttctttagtggcaagagagagttctggtactcttggtagatgtatcaagtattggactggaactcctctttcaggaggacccagaagctgtattttcttgcgtctccagctaaataaatgtaggtggggcaaaagcaatcatactcacctcatgcgtgttgaaaattgacaagacctatgcatagccatcaggtgtggtaaaatagcagagtatcatggcagaactgtgtgttcatttaagaacaatgggcaaggctcaagacaaaataatacaggaccgtcgcatttctttttctttatcccaccctccccaacctgagagttcacacacaggattgtattcttatattttctttctattcctccagtgaaaactcaaagatcaaatacactcatttaccttaagccataataaagctaaccaatgaggcttacttaatgcactctctttcccaagagctaattttgtttttactagtgaaaaacctgtatatagcttcagtcagcattctcaaagtacagccatgtgccactgtacacaaaatctttagcaataaataaatgaagattttttaaaaaactttaatagctatatctttatctgttttggaaaaataactagtatttccaatgttatttcagttattgctgtttaagacatgactgaggtacacagttaagtttaaaatgagtcagattttaaaagtgaataggacacatgttacatagtatggcaaaaatcatgaaaggtgttaagcaattgaatcctgtttgggaaacactggcttaggcgtttcataacgcaaatgaccaaagctttcctttttggacacaaaacatcatcagtaagctcagtagagaagtcacttgccagctgacttctctactgaagattcccttcaggcttggagaactgaatgatgtctgtagagtgacaggaaagtcatgggagagagtcatttctgtatacattatctttgctcaataagcatcataattcttgataatgagtggaaaaggtttcttgcatttttttgcatttttaaaaactgatctagatatttgtgacaggaatttttagaatgtcaagaaagctctctgattttgtttagatgacatgttaatttgtctaaatttttatgtgtttaatttagatgttgatgttagtgaagattcacctcctcccctacctgaaagaactcctgaatcgtttgtgttagcaagtgaacatagtgagtgtctcttttgcttttacatttacttcatattctaataataaactccgaaaaacatacctgattttaatctattagctattgtgctacataattaaattcaaaaacaagtaaattgatgttgacatgcttttaattctttgtttgaaaaatgcttttaaattatattttttacttgctaagatcgatagaaattactgcatttatgttagatatcagaattcaattcatttaaatgtaattataggctgggcatggtggttcaagcctgtgatcctagcactttgggaggcctaggcaggtggatcacctgaggtcaggagttggagaccagcctggccaacatggtgaaactccatctctactaaaaatataaaaattagctgggcatggtggtggacacctataatctcagctacttgagaggctgaggcaggaaaatgacttgaacccgggagttggaggttgcagtgagccgagattgcgccattgcattccagcctgggcgaagagcaagatttcgtctcaaaaagtaaataaataaataaatgcaattacaaagccaggtgcagtggctcatacctgtaatcccagcaccttgggaggctgagatgcactgatcacctgaggtcaggagttcaagaccagcgtgaccaacatggagaaaccccgtctctactaaaaatacaaaattagccaggcgtggtggcgcatgcctgtaatcccacctacttgggagactgaggcaggagaattgcttgaacctgggaggtggatattgcagtgagccgagatcacactattgcactccaacctgggcaacaagagcgaaactccatcttaaaaaaaaaatgcaattataagtgtatttgcaatctggtgtattttcattcattaaaaatagcacttattgactcatgcctgtaatcctgccactttgggagaccaaggcgggcagatcacgaggtcaggacatcaagaccatcctggctaacacactgaaaccctgtctctactagaaatacaaaaaattagctgtgtgtggtggcatgcaccagtagtcccagctgctcgggaggctgaggcaggagaatcgcttgaaccccggaggcagaggttggagtgagccgagaccatgccactgcactccagcctgggcaacagagcaagactccatctcaaaaaaaaaaaaagtagcacttatttatgaaaacattaattgctttccttagatttaggtcagtaaacatttctgttgggtgggcgtcactggattggtgttaactgaaagacatttaacaccactggagtagactgagcacattggctcatacctgtaatcgcagcactttgggagtccaaggcgcgaggattgcttgagcctaagagtttgagaccagcctgggcaacacagtgatacctcctctcttctaaaaataaaataactgtccagttgtggtggtgggcgcctgtaatcccagctgcttgggaggctgaggcaggagaattgcttgaacccaggatgcagaggttgcagcgagctgagaccacgccattgcattccagcctgggcaacaagagcaaaaaactttgtctcaaaaaataataataacaacaaaaaattagccaggtgtggtggcatgtgcctgtagtccttgctactcaggaggctgaagaagaaggattgcttgatccctgtagttggaggctgcagtgagccatgatcgcaccactgtactccagtttggtaacagtgagaccccgtctgtggaagaaaaaaaaaagaccactggagtatcagaactgggagaaagtgatgatactttaaaacattgataatatacttctccctattaatcctctaaaaaagagtgcagaaacagcttgattgtatttacagtgtctcatgctcagtggaggtgctcacttgtctaagtacattttaccaatatattaattttgactgatttttgttttgtttcatttggttttctttttatttatttattttttatttattcatttttttgagatggagtctcattctgtcgccccggctggagtgcagtggcacgatctcggctcactgcaagctccacctcttgggttcatgccattctcctgcctcagcctcccatgtagctgggactacaggtgcctgccaccacacccggcttatttttttgtattttttttagtagagacagggtttcaccgtgttagccaggatggtccatctcctgacctcatgatccgcccacctcagcctctcaaagtgctgggattacaggcatgagccaccacgcccggctaatttttttgtatttttttagtagagacagggtttcaccatgttagccaggatggtctccatctcctgacctcgtgatcgcccgcctcagcctcccaaagtgctgggattacaggcgggagccaccacgcccggccttgttttgttttatttcgagttggagttccactctgtcactcaggctggagtgcagtggcacgatctgggctcaagctgttctcctgcctcagcctcctgagtagctgcgattagaggcatacaccgtcactcccaactaatttttttattagagatagggtctcaccatgttggccaggctggtcttgaactcctgacctcaagtgatctgcctgcctcagcctcccaaagtgaattttgactgattttaagataaatgttaaagagccaagcacaatggcttatgcctgtgatcccagcactttgggagaccaaggcaggtggatctctgttccatttgccctaggagtttgagaccagcctgggcaacatggcaaaaccctgtctgtataaaatcaaaaattagccaggcgaggtggcatgcacctatagtcccagctactcaagaagctgagatgggaagattgcctgagcctgggaggttgaggctccagtgagccgagatcgcgcctggtcaacagagtgagaccctgtctcaacaacaattaaaaagaatgttgaaagcaatgaaacggtatacttcagttgtctaagtctgtcacgttgtctgtagattaagcagtatacttcacttgtctgtcacattatctatagactgtaatacactgatgactgaatttatttacttaggttttgaaggaaggaaacagaatgttctcgaattaatagaaactacaattttttttttttagaaacttcagaaatatgcttacccagaaactacaaaatttttgtggaagcgatagtttctaaaatctttaggatctgttttttgtattactttaatgcaaagaaatttcagaaattcaaggtgttaataacaataagatttcatttttctcagatacacctgtaagatcggaatggagtgaacttcaaagtcaggaacgatctgaacaaaaaaagtctgaagtaagtccttttggaattggaacagttatagcttaacatttctactcttttgttaactaatcttgcagttgttgaaatagctgtcatcttaagatcgttaaatatagtttgtaatttttgatcggcatttcttatactaagatttcagatgaaaagcccatataaaaggtaggttctgaaattttttaaaagggtaacctgatctacatacaactatcactttaaagtattgttttctcaagctgtttttgaaatatgtaaattatgcttcaaataattttgaaggtatgaatgaaataggagttactattttcagggtcctaattctttcttacatttctagatgcttcccattataacactaggcacatagtcgcttcttttgtttttttctggctacctggcatttctttgacattcgagaaatgttttggcaattaaatattttgagggcgtggcatggtggctcatgtctgtaatcacagcactttgggaggccaagcagaaggatcacttgagcccaggagttcaagaccatcctgggcaacatggggagaccttatctctacaaaaatttttaaaattagccaggcgtggtggcgcatgtctatggtcccagctttttgggaggctgagatgggaggattgcttgggccccagaggtcaaggctgcagtgagccatgatcacaccactgcactccagcctgagtgacagagtgagaccctgtctcagcaacaacacatttgtccataggagataacattttttattaacattaatactttttgtattttctcccatactttaatatctctgaaatttagctacatcttatatttgattttaagacatgatgtagtttaattgacatataaaatacaataatgatataattagtaatagtggctggcaaaacacagctgtatgttccttcatgcagtagcccatgcttttcagtgctcatccagaaacatttactccaaggagaaatagcataacattttaaaattttaagcctaattaaaaaacaattgtttgcttttcctctgatgctgaaaatgataggccttgatttcttgggatatatacccataacagacccagctttctattatttgtatataaaatgaatgtattgtaataggtattaaatgtcttcctcgtagggcttgataacctctgaaaatgagaaatgtggtaagttgttagattttttttttcctttttactgtagattttattgattaatttctacaaaataacatgcttcatagttcatgctatatagttatttctgtatgtgaaaatgtctaggacaactcttgtagaagcttaatattgtactataattcttccaaattaattattaccaccagatagtagtattgatctggaaaatcatgggagcatttactatcaataattacaggctaatgggaaagagattttttaaaaatatttttctgttttttattttctgtttttaaaaacacctagaagttagatcccgacttaaataaatgatggaattgcttctgtagaaacctattgttttagaaatcttccttttagtactttttcatttatttgtgaagaccaataaaattgtgaaagaatgaatgaattttagtagttaacatcttttgttactaatcttaaacactggtaattaaagagtaaactacaatctaaacaacataaaactttaaaagtggagttattaggcctggcgtggtggctcacacctataatcccagcactttgggagacccaggcaggcaatcacctgaggtcaggagttcgaaaccagccttgagcaacatggtgaaaccccgtctctactaaaaataaaaaaaatagctaggcgtcatgccatctgcctgtaatcccagctactagggagactgaggcaggagaatcccttgaaccccggaggcagaggttgcagtgcgccgagattgcgccattgcactccaacccgggcaacaagagggaaactccgtctcaaaaaaaaaaaaaaaaaaacaagtagagttattatttcaaggtgcaaatagtgcattaattaaccctgaccttgttgatttcttaaaatttttttttttttttttttttttttttttgagacagaggtcttgctctgtcgcccaggctggagtgcagtggcgcgatctcggctcactgcaagctccacctcctgggttcacaacattctcctgcctcagcctcctgagtagctgggactacaggcgcccgccaccacgcctggctaatttttttgtatttttagtagagacggggtttcaccatgttagccaggatgatctcgatatcctgacctcatgatcggctcgcctcggcctcccaaagtgctgggattacaggcatgagccaccgcgcctggcctgaccttgttgatttctatacaaagacatttcagttgcaactattcccttagaacataggcatatagtatagctaccttaagggaatgtaatatgtcaagacctagatttatgaagtaagaataacgagaatcctcacattgcagaagtactcactgcagatttctgtgtgaccacaataatacctgacatgattttctgtgcacactacacttgtatttatattgttcttgacctgtaaaattatggtgcccaggagagaaagttttctcttttcatgcttgccaacatttaaaaaattaaagagttatatatatatgatgctacaaaggatggtgattaacaaaggctttgtgttgctacttagatcatccagcgggaggtattcactatgaaatgtgcatagaatgtccacctactttcagtgacaagagagaacaaatatcagaaaatccaacagaagccacagatattggtaatttgtttaataaataatttttagtaagtagttaacactggcaggaatgagaaaagctcatttgccattgtgaaatgacacttgccaagaataaaacatgattttccaaagttgcttggactagtcatgaaataaatgaaatacttaattctatttcacattgagattaaaaactaaaatagaaaactgcagtataaaaaatcttttgtgttggaaagactaaattatcatggatatttttcttacattgtgataaaattggttttatttccagcataagatttttaaaagaagcaatcattttcagttattccaaataaatttacaattgttttgcatttaccaagttttgtttggcttaaattctaaattcccttgtggaaatttatttgttccagaaaatgagaatgtctgtggacatggtttttagtagtttgaaagtatttctgaacactgactagttattgtggtgttttcactgtaggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgccta

SEQ ID NO: 14539 - DNA, 264 bp, Homo sapiens
ggagacagtcttgctctgtcgcccagactggagtgcagtggcgtgatctcaactcactgccatctccacctcctgggctcaagcaattctcctgcctcagcctcccaagtatctgggactgcaggtgtgtgccaccacacctggcaaatttttgtattattagtagagatggggttttactgtgttgctcaggctggtctcaaactcctgagctcaattgatccacccaccttggcctcccaaagtgctgggattacaggcgtg

SEQ ID NO: 14540 - DNA, 1220 bp, Homo sapiens
atttttgttataaagataatacacacagagagaagcgcctgcagtgaatctttgtgtaaccatcatgcagatcaggagacaaaccatggcggcccctcagaactctgccacgtgtttcttcccatcttttcctgctgctgctcccagaagtaaccctattccgacttttctgggttttcttggtaatcaatttctggtttttctttatagagttgttgcctaagtatgcacccttcaacacgatactgttgttttgcttgtactttttgttaactgtacatataataaattatgttatatatttctttattgcaggctcctttaatccagtgttatgtttgggagacgcacccatacaactgcatgtcaccgtagcttgttcatttccagtgtcgtgtagtgtcccttcatgtgaatttatcacagtttattagtatcttccactctgatggacatttggtagttggaattttcattactaatgatgcccctgcctgtggtcattcctgcctgcctcttgatgcacacaggcacgcatttctgctgggtatgtcctagttccagactcactggttatacggtatggatgtaattattgttagttttccagtgtgattaaacatcagattagcgcccattagcaatgtctgaggctgcctgttgctccactcgggtgcccgtttggtattaggagcttcttcagccattcttgtgtttgtgttcatgtatctcattgtggttttaattttcatttctataatgactaatgtggttgaatatgtttttgtatgattatttgccatttgtatttgctctttttaaagtatttgtacaggactttcacccattctcttattgtgttgccttatataggaattatttctatgttctagatatggatcctttgctggccatatatgttgaaagtatctccactctttggcttgcctttcattattttaattgtgtcttgctgaacagaaggttttaatgtcaaggtagtttttagtcaatcccctcatttatgattggtgcattttgtcaggtttaagaagtcttttctctcccataagaacgtgaagaaaacatattctcctatgttttatagaccataggttggcaaacttttttctgtaaaggactaaatagtaaacattttaagctttgtggaccacagatagtctctgctacatattcatcttaaaaaaaaaaaaagaata

SEQ ID NO: 14541 - DNA, 409 bp, Homo sapiens
caggactgatggtgaaacctgaaggcatagacatgacccatagctgcctttatgttttacaacttcctgttgattttcattttcctcgtttgtcagtcatctcccttgacttcccacatctatctatgttgcatcctagcctggtgcctggcctggcggaggcattggagcattggaaagaatgaatgaatgagtttagccctctggagagtgtatgctgaaaaactgttacctcgcctttaagagcttaaaagtgaagagaatgaattttgatagaaccattttttaaagtaaggaccatccttctgtgtccccagaaaattaaatagagtcagaaaatggcaaagccaagttagaagcattcaggtgtggaagttgtatagggcacttgagttaaaaaaaaaaaaaa

SEQ ID NO: 14542 - DNA, 409 bp, Homo sapiens; identical to SEQ ID NO: 14541

SEQ ID NO: 14543 - DNA, 599 bp, Homo sapiens
aaataatgacttttggtgctgtgggatttgtgagctcaaggacttgtgctgcaagaacaacaaatagcagcctgcttatttaatagaaagtgccctcagtgagggtctgatctgcttttggcttgaggaatgcttcagaattttaattatttggaggagcttccttgaagttgctttatggttgctttctcttcacatcaaactgaagacataactgtaacaaatgagtattcctacaccaagatgtgacacagcaaatgaatttatggatgatgacattaatgatcatcatcagcatggctagggttctggtttgattagtagctcagactgctttcttaagatgaaatagtcatttaaatgaacatggcatcttctcttgaacaatgcttaggttatttttttttctcatagagattgaagacccattactcagcattatctccctctctcccctgaaacttttgtctgttcggaatgagctactccaggaagatttattgcttttcctcagtgttcttattagcatgctttatatagcttattgtgacacttatgataatacaaaaagtaataaaaatacaattattatcattcgg

SEQ ID NO: 14544 - DNA, 599 bp, Homo sapiens; identical to SEQ ID NO: 14543

SEQ ID NO: 14545 - DNA, 10117 bp, Homo sapiens
gaagccaggagtcctttagaagtctatgattcccatcaccgcggggctggacagctctcttggggaccttccctgtgcacctgtgaccgtgtctgcccctcataacaccctagtcacaatgccctttcagttccccaaaaaagctagactggtcccacttctgggcctctgcctggagtattcacagaccctcagtcgggccccagcttggatgagtgtcagcagaggccctccccactccacctggattaaagcaggtctgcctggcgccctgcaccacacacccttccctccctcagcgtgtctggcccgaccagcacgcagcttccatgatggcagggcctggcctctcctgcacgccatgcaggcctggcccttgccaaccactggaccttagtaaatatttgaggagcaaaagaatgaaacgctaggtgggtgcatgagtggtggcagagtctggttctgaggtttctgagcttaaggccgtgcagcagctggctctgctcccttgagattctggtgcccactcccttgccaggtttcaggcacccgtggatgagcagtcagagagtctacagaacacgcacgacgacagcaggaacaacgcggcctcagccaggtaaagcaagtctctccactggagagtgtgcacgcgatgtggcttctgaggccaacaggacgacaaaggaaactccaggcttttcccctttggcgccagctctggggccctggctgggcctctttgtaaaacaaggggtcagagaggctctcagcccagatgagtaacttataagtgacctcatagataaaacaggtgttcctttgatagacagaaccccattttaccattataaacagccatggctgctgcctgcatccactttcaccactgggagctgcacgtgcttatgctaggggactcgggtcactgaaatgagaaagtgaccgaggactgttccccagagccagcgcatgcgccccagtacctgccagaggaagacggctgtgcattaacacctacgacacagtcacaggctgatctttgtgtattttgctttcaggaaaacatagtcacagggcagaggacagcactgtagaatgagaaccagaagagcctaggggtgtgcagagggttgctgaagtggccagagtcacagcgcggctggtgacagagcagagtctggccccagcctcccctgcacagccgccatttattagctcagatgcttccaaattcaaaatgcagtgtcaccagaaaccgctgacacaggctgatggttcagcaactcacagccatcccctggggatgggctcctactcagaagtagacaaggtccttttggagacagagccttcctggttctcactcactgaggccttccaggaagacgttccattctgagtgctttggcccaagtggattttagtgcagggatatggtgaaatgggggagcgggctgggcttacatgaggctgtccctttaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgtaaaaagaagagtagaataattactccgttcagttcctctccttgcaatgggataggctgcctctgctgcagatggctgggtcttccaaacccatgacaagtgccacggcctctgcagcagtggcccagagagtaggcacttcccagcatgacagagaggccgaggccttctaaccttgccaaaccactacaaaagcaaactagggtgggcaagcccaactacctaaggcaggaagaaagtgcagtgaagggacagtggtgtgctgtgcgtatcgtgggggtactcctaagcagctagctgttggcgagatcttacaaagcctgatcggctaacgcagcttcctggtttaggaacattttccccggtcgtatcaatcccccaggttggtaaatgaacagaagggatgaataaagcctactttttaggctcaaggagcagctcgtgaaggggtggcaggtgcgctgctgccttgttttctgtcctgctaagaggctcaccccgcgacctcttctgtaaactgccactcagcagcggcctgcaagccctcacgaaaggcttcactctatgctgtttccaggtagctttgttctgacagtacctattttccacttcagaatctccactttaaaacctgcaatggaaaaataaatctcttgacagttttttaaatcgagaaaattggtgatgtggccttggcagcaaatacccagaaagcctttacctcattaacctgattctccacgggccctgccactgctaaatttataaagctaaaaataatctcaagatcatggaactaaaaagaagtcaatcacttaccaaatcctgtccttaaggagttcatcttggctgggcgtggtggctcacgcctgtaatcccagcactttgggaggccgaggcgcgtggatcacttgaggtcaggagttcgagaccagcctggccatcatggtgaaaccccgtctctactaaaaatacaaaaaaattagctgggcatggtggcccaagcctgtaatcccagctactcaggaggctgaggcaggagaatcgcttgaacccgggaggcagaggttgcggtgagccgaaatggtgccactgcactccagcctccagcctgggccacagagcaagactgtcttaagaaaataaaaaaaatggagttcatcttttatccctaagtaattgctgacttctgctctgggattataaacagggtgggaatgttctcccaccatccctacccctggaattcctctccaaagcagagtacgtcaagttttccctggtgtcagacagcatttcaccatgaaaccctaagacctgcctcctgggctccttccagctggtgggcctggtgtgaaggtgggcttcctgggcctctggcagatggaggatggcattaaatgccaacacagtcagcttaccatccacaaggccagcagctgccaacagctgccctagacctatcaacaagacaacttcatggctcccaatgggaatggaggctgggcccgccctacttagagcaggggaaagaacttttccctcaaagagccggggcaggatgccagaatctaactacatcctctcccggtttgcagttctaggaagtggaatttgctgccctaggcgtggtctaaaggacaagtttagaaatgattcaactcaagttcctaaacagagtaagtgccagttgatgtcccaccgtggatcctttactccagaaaaattgtaatgatggctcggccaccgccttggctagagtcccactgcacgcgtgtcgtgagggccgatgggcaagtccgtccggttttttttgttgttgttgttgttttttgagatggagtctcgccctgttgcccagactgaagtgcaaaggcccgatctcaactcactgcaacctccgcctcctgggttcaaaggattctcctgtctcagcctcctgagtagctgggattacaggcacccgccagcacgcccagctatttttttgtatttttagtagagacggggttttatcatgttggccaggctggtctcgaacgcctgacctcatgatccacccgccttggcctcccaaattgctgggattacaggcgtgagccaccgcgcccggccgtctgtctggttttcaaaccaatcaatgaacccgtaagcctctttggtatatataacaatgaaaaaattcattaagccatgaaatctagaaataagtcatatttctgagttgataaaatgcttttctgaacatacattttaggtatctggcacaattaaccaaatgtctgcccatttttgtgtagctttcatacagtacagatttcattgatgtcgctcccacatctgagtattaaaaacatttgacattgttcttctcagtcctcacaacacccctgtgaggtaggtggtattgaccccattccacagatggggaggtctaggcacggaaaggtttagtggctcctcacaggccgcgtggtggggcagcagagtggtgctctggccccgcgccgacgccgccttcacattcacacttcttcagtgccaccgcaacactgcatggcaggatctcacgctgaggccaagttcctgtctagtccagaatgaagccagcgtctcacctcttaaagcttcgatgtgtgactcaaagccaacttactctcccaaacttgcaaaacaaacatactgactgaatcttagttgggactatttgcagtatttaagattatttttgagagtcaatctgcttggatttgtagttgtatatgctcaaatccctttggaaaacagtttgaaatgacatgagggacaatgtaattttgagaacagaacacagaaaacaagagttctgagactggcattgaaattgagaatataagctatggtaaaatgagaatcaaatcccaaataaacggagagcagcacttctcaatgtttaaggccacgcacagggcaggcattcagtaagcacttcttggatcaaaagaaactgatgctcctttgagccgcctatcactgacaacaggagctgagacccccgggaaagccagccagggccatgatccccttggcctggggccacggtcacacaaagccactcagccaaatcgtgtagagttatctaggcttacttgctgcaggataaaagttgaactagaacaccaagcattgagctaggaatacccctttgaatgtgtactgctacttataaaaaataggtatgtagctatgattaaatagatgaagggccaaagcatcctatgaggaagtatttttaaaattgtatagatgttcatgcagtgggggacagaaataaagaggttaaagcggtctgtgtttttcggttaaatgaaaggttgtaaatgcatttttaccgctgataagaaggggtacctgctacccctttctgctgtggagtgttgctgaggacagagtccatctctcccagcgagtcctggttatcctttacttacactctggcctcgggggcagtggcgtgtggcctcggtcctccccaggtaactctggagggcgctgtggaatattgctgtgatttgccccttactcgtctttcacccatgttccgccttgattcggcataaggacagactgctccagtggggccttgggtcctcaggccttctgaccgcttggtcttgagtgacattccagaagagtgactaatgacataaaacgattaagaaaatccatgtggcagcggccaaccggaaacagttttgtcccaggctgcacagggtcggaggccccaaggtcaccggggccactgcccgtcacaggtccaccttgaccccctttatgaaaggcaggcccgtgggcaccctcttcttatactccaggtactcctctccaaaaaagtgaattagtgagatttcttcttcttctgttcgatcgcggaagaatcgccacactgtcagggcatagctgacgccgcagatggggttacacagcatcacctaacagagggagacaccaggctcatcagggtgaccgtgggatgacgccctgtgctttggtaggcgtctgtctctaatacccagaggatttctgtgcccatgccctgctgagaccgtcagggtctctgggagcagtactgtcaccttagccctgagcactcagtgctgcaggcctttctcacgtgctttcctgttgctcctcttacatgagagagatctgtaaatcacaagatcaacctcttggatttcaaccctcagcttggggtgacagcaatgccccccacctccaggtgtgagctccccaacatgaggtcccatgcacgctgccttcctgcccaggaccctcccaccacaaatgcattcgcttacaccacagctgcctgggcctctgcctcctaaacccacagcctctgcttcagcacgagatacagtgccacaaaactcagcttccgaaatgccccttccagcagattacctccacgctcagagagctccagagactgaaccccaccccctgagtctgggtttccaaccccagaagagcagcacttcgcccacttccccagtctcctgccctccccacgctgtgcccactttgcctcttttttttcccccgagacagattgtcactctgtcacgtggagtgcagtggcgtgatcatggctcactgcagccttaactgcttgggctcaagtgattctcccacctcagcctcccaagtagctgggactaagggcacatgccaccacacccagctaatttttgtattttttgtagagatggggtttcacaatgttgcccaagctggtctcgaactcctggccctttcttccacctttaagaacatcctggccaggtacggtggctcatgtctgttaattgcagtactttgggaggccaaggagggcagatcacctgaggtcaggagcttgagacaagcttggccaacatggcgaatccccgtctctaccaaaaatagaaaaattagctgggcgtagtggtgggagcctgtaatcccagctacttgggaggctgaggcaggagaattgcttgaacccaggaggcagaggttgcagtgagctgagatcgccactgcataccagcctgggcgacagagcgaaactccctctcaaaaaaaacaaagaacatccttcccactgatctccagccaaacagtccttcaaggccaaaagcattccccagctcctcagggaaccactcacctacacctgcccactggtcccctgtggatgtgcatcttccccaacatacattttctgtatgttttctgaatatatattttaggctccaatacagccacccggagagccaggctcatgtcctgacctctcacaccttctcttattgagcacttactatgttcccagcgccatgctaagccctttacaatcattaccctgttcaactctcatggcaaacctttgagggcacgctactatccccactttgttttttttaaaattttattattttttaaagacagggtctcactatattgcccaggctggacttgaactcttggcctcaagccatcctcctgcctcagcttccagagtagggggaactacaggcatgtgccactatgtctagctgcccccactttaacatgagaggagaaggaggccaagcagtgaatgtcagaatcaggactggcccagtcagtgactccggggcctgtaccctcacatctggcatagcttgctggggataccctacagtgggagttctctatagcaggctgcagcctgttactaagccatgaaatcatttagtacattatgaacagtattgaaataataagatagaaaacaggattttgtaaacagtaagtgtaagtattatatcaggaaagacatgttcctttcatacacacacaagtgctggagcacaatgtaaaaaaaatctatgggcaaaaaggtatggaaaaccctttggttctagtgcacacacatatacaggaagcaagcatttatggcaaattacattattcagtcataactaatttgttcccagggaaggtgattgttaatgtggcggttttacatgtttcagaaacaaaaattgtaaatgctatgtgatcatttgccccacctataccgttaggggtcaccagagtcaccaaggaccatgcattgctgatgggatgcctgagagatctctggatttgcccaaagacttggagacttttcccaaacacttcgtgaattttccaagatctattcacattctttggccaagtttttctaggaccaagagtaaagaatcaagaaacagtttcaagaaataaggcggccaggcgcgatggctcacgcctgtaatcccagcactttgggagactgaggcaagtggatcatgaggtcaggagattgagatcatcctggctaacacagtgaaaccccgtctctactaaaaatacaaaaaatttagccaggcatggtggcgggcgcctgtagtcccagctactcaggaggctgaggcaggagaatggcgtgaacccaggaggcggagcttgcagtgagccgagattgcgccactgcactccagcctgggcgacagagcgagactctgtctcaaaaagaaaaaa

SEQ ID NO: 14546 - DNA, 7507 bp, Homo sapiens
gaagccaggagtcctttagaagtctatgattcccatcaccgcggggctggacagctctcttggggaccttccctgtgcacctgtgaccgtgtctgcccctcataacaccctagtcacaatgccctttcagttccccaaaaaagctagactggtcccacttctgggcctctgcctggagtattcacagaccctcagtcgggccccagcttggatgagtgtcagcagaggccctccccactccacctggattaaagcaggtctgcctggcgccctgcaccacacacccttccctccctcagcgtgtctggcccgaccagcacgcagcttccatgatggcagggcctggcctctcctgcacgccatgcaggcctggcccttgccaaccactggaccttagtaaatatttgaggagcaaaagaatgaaacgctaggtgggtgcatgagtggtggcagagtctggttctgaggtttctgagcttaaggccgtgcagcagctggctctgctcccttgagattctggtgcccactcccttgccaggtttcaggcacccgtggatgagcagtcagagagtctacagaacacgcacgacgacagcaggaacagcgcggcctcagccaggtaaagcaagtctctccactggagagtgtgcacgcgatgtggcttctgaggccaacaggacgacaaaggaaactccaggcttttcccctttggcgccagctctggggccctggctgggcctctttgtaaaacaaggggtcagagaggctctcagcccagatgagtaacttataagtgacctcatagataaaacaggtgttcctttgatagacagaaccccattttaccattataaacagccatggctgctgcctgcatccactttcaccactgggagctgcacgtgcttatgctaggggactcgggtcactgaaatgagaaagtgaccgaggactgttccccagagccagcgcatgcgccccagtacctgccagaggaagacggctgtgcattaacacctacgacacagtcacaggctgatctttgtgtattttgctttcaggaaaacatagtcacagggcagaggacagcactgtagaatgagaaccagaagagcctaggggtgtgcagagggttgctgaagtggccagagtcacagcgcggctggtgacagagcagagtctggccccagcctcccctgcacagccgccatttattagctcagatgcttccaaattcaaaatgcagtgtcaccagaaaccgctgacacaggctgatggttcagcaactcacagccatcccctggggatgggctcctactcagaagtagacaaggtccttttggagacagagccttcctggttctcactcactgaggccttccaggaagacgttccattctgagtgctttggcccaagtggattttagtgcagggatatggtgaaatgggggagcgggctgggcttacatgaggctgtccctttaggaataatccaggaagtgtcccggaaaagagagagaagacatcagagcctaaaggaaacagctgggctccgaacgccctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgtaaaaagaagagtagaataattactccgttcagttcctctccttgcaatgggataggctgcctctgctgcagatggctgggtcttccaaacccatgacaagtgccacggcctctgcagcagtggcccagagagtaggcacttcccagcatgacagagaggccgaggccttctaaccttgccaaaccactacaaaagcaaactagggtgggcaagcccaactacctaaggcaggaagaaagtgcagtgaagggacagtggtgtgctgtgcgtatcgtgggggtactcctaagcagctagctgttggcgagatcttacaaagcctgatcggctaacgcagcttcctggtttaggaacattttccccggtcgtatcaatcccccaggttggtaaatgaacagaagggatgaataaagcctactttttaggctcaaggagcagctcgtgaaggggtggcaggtgcgctgctgccttgttttctgtcctgctaagaggctcaccccgcgacctcttctgtaaactgccactcagcagcggcctgcaagccctcacgaaaggcttcactctatgctgtttccaggtagctttgttctgacagtacctattttccacttcagaatctccactttaaaacctgcaatggaaaaataaatctcttgacagttttttaaatcgagaaaattggtgatgtggccttggcagcaaatacccagaaagcctttacctcattaacctgattctccacgggccctgccactgctaaatttataaagctaaaaataatctcaagatcatggaactaaaaagaagtcaatcacttaccaaatcctgtccttaaggagttcatcttggctgggcgtggtggctcacgcctgtaatcccagcactttgggaggccgaggcgcgtggatcacttgaggtcaggagttcgagaccagcctggccatcatggtgaaaccccgtctctactaaaaatacaaaaaaattagctgggcatggtggcccaagcctgtaatcccagctactcaggaggctgaggcaggagaatcgcttgaacccgggaggcagaggttgcggtgagccgaaatggtgccactgcactccagcctccagcctgggccacagagcaagactgtcttaagaaaataaaaaaaatggagttcatcttttatccctaagtaattgctgacttctgctctgggattataaacagggtgggaatgttctcccaccatccctacccctggaattcctctccaaagcagagtacgtcaagttttccctggtgtcagacagcatttcaccatgaaaccctaagacctgcctcctgggctccttccagctggtgggcctggtgtgaaggtgggcttcctgggcctctggcagatggaggatggcattaaatgccaacacagtcagcttaccatccacaaggccagcagctgccaacagctgccctagacctatcaacaagacaacttcatggctcccaatgggaatggaggctgggcccgccctacttagagcaggggaaagaacttttccctcaaagagccggggcaggatgccagaatctaactacatcctctcccggtttgcaggtctaggaagtggaatttgctgccctaggcgtggtctaaaggacaagtttagaaatgattcaactcaagttcctaaacagagtaagtgccagttgatgtcccaccgtggatcctttactccagaaaaattgtaatgatggctcggccaccgccttggctagagtcccactgcacgcgtgtcgtgagggccgatgggcaagtccgtccggttttttttgtagttgttggtgatttttgagatggagtctcgccctgttgcccagactgaagtgcaaaggcccgatctcaactcactgcaacctccggctcctgggttcaaaggattctactgtctcagcctcctgagtagctgggattacaggcacccgccagcacgcccagctatttttttgtatttttagtagagacggggttttatcatgttggccaggctggtctcgaacgcctgacctcatgatccacccgccttggcctcccaaattgctgggattacaggcgtgagccaccgcgcccggccgtctgtctggttttcaaaccaatcaatgaacccgtaagcctctttggtatatataacaatgaaaaaattcattaagccatgaatctagaaataagtcatatttctgagttgataaaatgcttttctgaacatacattttaggtatctggcacaattaaccaaatgtctgcccatttttgtgtagctttcatacagtacagatttcattgatgtcgctcccacatctgagtattaaaaacatttgacattgttcttctcagtcctcacaacacccctgtgaggtaggtggtattgaccccattccacagatggggaggtctaggcacggaaaggtttagtggctcctcacaggccgcgtggtggggcagcagagtggtgctctggccccgcgccgacgccgccttcacattcacacttcttcagtgccaccgcaacactgcatggcaggatctcacgctgaggccaagttcctgtctagtccagaatgaagccagcgtctcacctcttaaagcttcgatgtgtgactcaaagccaacttactctcccaaacttgcaaaacaaacatactgactgaatcttagttgggactatttgcagtatttaagattatttttgagagtcaatctgcttggatttgtagttgtatatgctcaaatccctttggaaaacagtttgaaatgacatgagggacaatgtaattttgagaacagaacacagaaaacaagagttctgagactggcattgaaattgagaatataagctatggtaaaatgagaatcaaatcccaaataaacggagagcagcacttctcaatgtttaaggccacgcacagggcaggcattcagtaagcacttcttggatcaaaagaaactgatgctcctttgagccgcctatcactgacaacaggagctgagacccccgggaaagccagccagggccatgatccccttggcctggggccacggtcacacaaagccactcagccaaatcgtgtagagttatctaggcttacttgctgcaggataaaagttgaactagaacaccaagcattgagctaggaatacccctttgaatgtgtactgctacttataaaaaataggtatgtagctatgattaaatacatgaagggccaaagcatcctatgaggaagtatttttaaaattgtatagatgttcatgcagtgggggacagaaataaagaggttaaagcggtctgtgtttttcggtaaactgaaaggttgtaaatgcatttttaccgctgataagaaggggtacctgctaaccctttctgctggtggagtgttgctgaggacagagtccatctctcccagcgagtcctggttatcctttacttacactctggcctcgggggcagtggcgtgtggcctcggtcctccccaggtaactctggagggcgctgtggaatattgctgtgatttgccccttactcgtctttcacccatgttccgccttgattcggcataaggacagactgctccagtggggccttgggtcctcaggccttctgaccgcttggtcttgagtgacattccagaagagtgactaatgacataaaacgattaagaaaatccatgtggcagcggccaaccggaaacagttttgtcccaggctgcacagggtcggaggccccaaggtcaccggggccactgcccgtcacaggtccaccttgaccccctttatgaaaggcaggcccgtgggcaccctcttcttatactccaggtactcctctccaaaaaagtgaattagtgagatttctctatcttctgttcgatcgcggaagaatcgccacactgtcaggggatagctgacgccgcagatggggttacacagc

SEQ ID NO: 14547 - DNA, 150 bp, Homo sapiens
tggtttctttttcttttttttttttgagatggagtctcgctctgtcgcccaggctggagtacggtggcgcgatctcggctcactgcaagctccgcctcccgggttcacgccattctcctgcctcagcctcccaagtagctgggactacag

SEQ ID NO: 14548 - DNA, 428 bp, Homo sapiens
ggctcaatcaatcctcccacctcagcctcctgggtagctgtgactacaggcatgtgccaccatgcccggctaatttttatagttttggtagagatggggttgtgctatgttgccaaagatggtctccaactcctgggctaagtgatcctcccacctcagccttccaaaatgctgggattatagacgtgaccgtgcctagccatgttagtcttcagtacaccttctctttgctgacagccccgcgctcccatgctcctgccagcctctccagccgttccttcctggtctctggctggctctgcctcctcagctcagtgcccagatatgtttttccccagggctcagccttaggcattctccacagcctacgctcactccttgggcgacctcattcagtccctggctttaagaccccatcatgacgcaga

SEQ ID NO: 14549 - DNA, 428 bp, Homo sapiens; identical to SEQ ID NO: 14548

SEQ ID NO: 14550 - DNA, 1765 bp, Homo sapiens
gggattcggcggcggcggcggcgcgggcgcgcgcttcctagtgacgcaggcggcggggccgcgcacgcacggggctgggagggccggacacttatttggcgctcgcggaggaggaaggcggggccgtgaaataaggcccgacgggccccggggcgcgtgcgcggaccgacactgtcagctcctaacgccgcaggttcctcctggtccccgaggcccccggtcgggcgttgcctgccccgcgcgggcggccgggccgagggacgatggtcagtggacggacggcgccagggagcagtgcccacgcgcggcagggcggtaccttcaggcctccaggtacgggcgctcctcgcccggacgctgctgtgtgtgaatgggcgcgaggggactcccctgcggggcggacgcctgaacacgaggctgtggaggaggacgctgtagggtgcgcggactcacgcggaacatgccagaggctcagccagccacggcgctcccagcgtggagggcgaggggcatccgggagcggccgggagggctcggtcacccctcaagctgtcaccccagtcccacaaccagcaccccgatcctatcgcagtcccacagccgacaccccgatcccacccctgcccaacagccggcacccaccccaatcccatagctaacaccccggtcccaccgctgtcccacggccggcaccccgatcccaccccagtcccgcagctggcaccccgatcccaccccagcccaacagctggcacccaccccgatcccaccgctgtcccacagccggcaccccgatcccaccccagtcccgcagccggcaccccgatcccacagccggcactcaccccgatcgcatagcatagctgataccccgatcccaccccagtcccatagccagcaccccgatcccaccccagtcccatagccagcacctcgatcccatagatgacaccccgatcccgccccagtcctatagcccgcaccccgatcccacccgagtcccgcagccggcaccccatcccacccatgtcccacagtcggcaccccgatcccactcggatccggcagccagcttggatcctgtggccctcctccagcccccagggctcatttatatgttttattggcagaggctggggctggctctgttggcctctgtgctgggtttcttcctctgcaccgcaggactggctctcctgacctctccaggtgtcatcgaacacccttgtgcttgctgtcacccgctgcctgtctgcaggatcccggattccgtatcaggggaccgaaattagtcggaaaataggaagcaggtgctcgcttggatggaaccctgaccctgtgctcacacttgtaggaggagggctctgcaggccgcctcccggaacgggaggttcccaagccactgcacttcggaggggctgtaattagagttgcacattcattcagttcccagtaaagtagaacgtgctccagccagtgaggaaaaggtgtttttaaaaattagattggccgagtgcggtggctcatgccttttacctcaacactttgggagacaaaggtgggaggatcacctgtggccaggagttcaagaccagcctgggcaacagagcctgtctctggggaagaataaaaaaaaaaattgagcctttgtcagtgctactattttattatctggtaaatatgagagggttcacgcggtctatgtgtgtcatttatctgagtttgcctatcgtcacgttttggaaataaatgtcaataaagtcga

SEQ ID NO: 14551 - DNA, 5135 bp, Homo sapiens
  misc_feature (5110)..(5110): n equals a,t,g, or c
gagaccatcctggctaacactgtgaaaccccctctctactaaaaatacaaaaaattagcctggcgtggtggcaggcgcctgtagtcccagctactcgggaggctgaggcaggagaatggcgtgaacccaggaagcggagcttgcagtgagccgagatggcgccactgcactccagcctaggcaacagagcaagactccgtctcaaaaaataaataaataaaactgcaaatgtattctctaactgttctgtaggtcggaagtccagcccagcctcactccgccaaaatcagggtgtctgcagggccgattgcttttggagctccaggggagaagctgttctggcctttccagtttctggaagcacttgagccccttgtctcgtggcctatcccacacctgaaagccagccaaagccagttgagtcctcaccctgttggccccgacactgatctcctgcctccctcatctgctgtcaaggccccttgtgatgacatggggccaccagctggcccagggcacctcctgtcagagtccgccgaccagtgaccttcattccatctgtcgctgtaattcccctttgcttggaaccaacgttcacagatcccaggggttaggatgtgaatatcttgggcagggctgtgggggggctattcttccttctaaaatatttatcatttttgttttggggatttttttggtttggttttttttgagacagagtctcgctctgtcgcccaggttggagtgcaatggtgcaatctcagctcactgcaacctctgcctccgggcagacgtgagccactgcaccaggcctgtttttgtttttgtttgttttgttttgtttttgagatggagtctcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagagatggagtctcactttgtcacccaggctggagtgtagtggcgggattataggtacgcgccatcatgcccagttactttttgtatttttagtagagacagggttttaccatgttggtcagactggtctcaaactcctgatctcaggtaatccacccgcctcagcctcccaaagtgctgggattacagacgtgagccaccgtgtctggccatatttattaactacaaagggaaagatgataatttttttttttgagatggagtctcactctgtcacccaggctggagtacaatagcgtgatcttggctcactgaaacctctgcctcccaggttcaagcgattctcctgcctcagcctcccaactagctgggattacaggcgcacgctaccaagcccagctaatttttgtatttttagtagaaacggagtttcaccatgttggtgaggctggtctcgaactcctgaccttgtgatctgcccacctcggcctcccaaagtgctgggattataggcatgagccactgcaaccggctgaaagatggtaattttaaagtagagaaactgggttggctgggcatggtggcttatgcctgtaagctcagcactttggaagtccaaggcaagaggatcgcttgagtccaggagtttgagaccagcctggacaatatagcaagaccccatctccgcaaaagctaaaaagttagccaggtgtggcggcacatgcctgtagtcccagctactcaggaggctgacgtgggaggatcacttgagaccaggaggtcaaggctgaagtgagctgttattgtgccactgcactcagcctgggcaacagagcgagagtctgtctccaaaggtaaaaaaaggtccaggcacagtggctcacacctgtaatctcagcactttgggaggccgaggcgggcagattcgttgaggtcaggagttcaaaacgagcctggctaaatggtgaaaccccgtctctactaaaaatacaaaaaaattagccaggcatggtgacgggcgcctgtaatctcagctacttgggagactgaggcaggagaatcatgtaaacccaggaggctgaggttgcagcgagccaagatcatgccactgcacttcagcctgggcgacagagcaagactgtctcaaaacaaaacaaaagaatcttgagtcctgagttcctctaagggaaattccaggcacctcgccacccttgacaggcaaaggaacaatctgatgaggaagaagatagaaacagcttaaacaatagtctcccggccgggggcagtggctcacgcctgtaatctgagcactttgggaggccgaggcgggtggatcacaaggtcaagagatcaagaccatcctggctaacatggtgaaaccccgtctctactaaaaatacaaaaaattagccgggcgtggtggtgggtgcctgtagtcccagctactcgggaggctgaggcaggagaatggcgtgaacccaggaggcggagctttcagtgagctgatatcgcgcctctgcactccagcctgggcgacagagcctcgagactccatctcaaaaaaaaaaaaaaattagctgggtgtggtggctcacacctgtaatcccagctacgtggcaggctgaggcaggagaatcgcttgaacctgggaggcggaggttgtagggagctgagatcgcaccactgcactccagcctgggcaacagagcgagactctgtctcaaagaaaaaaaaaaaaaacaaaaaaacaatagtctcccaagtaagtcagagtcacaaggtgttttgattccctgtggaaactaaaatataacagcttaacatatgttcttgagttatttttcagaaacttggacatccaccaggtggaaaatgctgagctaggaacagtggctataatttcagccttttgagaggccaaggtggaaggatcacttgaggccaggagttagagaccagcctggccaacatggtgaaaccccgtctctagtaaaaatacaaatattagctgggcatggtggtgcaacctgaaatcccagctacttgggagacctagctgggaggatcgcttgaacctggtaggaggagtttgcagtgagctgaaattgtgccactgcactctagcctgggcaacagagtgagactctgtctcaaaaaataaataaataaaaagagaaaaaagtgttgcctgcaggccgggcacagtggctcacgcctgtaatcccaacactttgggaggccgagatgggcagatcacctgaggtcaggagtgcaagaacagcctggccaacatggtgaaaccccatctctactaaaaatacaaaagttagctgggtgtgtacatgtagtctcagctacttgggaagctgaggcaggagaatctcttcaaccggggaggtggaggttgcgatgagctgagatcacgccaccacactccatccagcctgggtgacagagtgagactccatctcaaagcaaaaaaagaaacataggtgggacccttggtgtgtccttagggcatgatggttgaggtatactgctggtcctgtcatgtaaaagaaaacgagccgactctgtgtctactggagaaagcactgcatatatcagccacagtcaatacctcgcttctgcagggacggtggctgccagagtgggaggctttggtagcacccatgtcgtggaatcacaatgttgtcgatagctctggggtcttgtacaaaatgccagatcctcccatttggtttccttatgggaaggatcgcagtactataatacatgggcttgtgcaagggatcattatacccttttctctttttttgcttttctttgagacagagtttcactctcgtcacccaggctggagtgcaatggcgcgatcttggctcactgcaacctccacctcctgggttcaagtgattttcctggctcagccttctgagtagctgggattacacatgcccgccaccaggcctgacttatttttgtatttttagtagagacagggtttcaccaagttggtcaggctggtcttgaactcctgacctcaggtgatccacccacctcggcctcccaaagtgttgggatttcaggcataagccaccaggcccagcctttctttctttttaaaattaatctttgtttaaaaatactctcattttttatttaattgtagcactcctagatcccgaaagcagatacactcttgttatgggtctgattcttttcattgcttcacgccttagaggatattgtccaatactggataaaagtttactcaggtctacttccactttaacggggatggctgaatatctcttccacttggctgttcgtttataatgaactgacaaacatacaaattttcttgagttctgtgagacattctagtaaatcatctaacctgaagagcaggttgtgagaacccctgatttagaaagcccagtggtcataaatataagtggctctggactggctcccggggtctgaagtgtgggcagtcggttaggattgagcccttgtaatttgtaggatctgacacaccctccaggaaggcagtgtcagaatttacctgtattatattggacacccagttagcggttggagaattggttgctggtatagaaaaataccaaatattttatgtcaggggagtgaaagaaaaaacaaaaacccggccgggcgcggtggctcacgcctgtcatcccagcactttgggaggccgagacgggcggatcacgaggtcaggagatcgagaccatcctggctaacacggtgaaaccccatctctactaaaaatacaaaaattagccgggcgtggtggcgcgcgcctgtagtcccagctactcgggaggctgaggcaggagaatggcgtgaacccgggaggcggagcttgcagtgagcccagatcgcgccaccgcactccagcctgggcgacagagcgagataangtctcaaaaaaaaaaaaaaaaaaaa

SEQ ID NO: 14552 - DNA, 1012 bp, Homo sapiens; identical to SEQ ID NO: 10129
  misc_feature (39)..(838): n equals a,t,g, or c

SEQ ID NO: 14553 - DNA, 973 bp, Homo sapiens
  misc_feature (972)..(972): n equals a,t,g, or c
agtgaattaatgtaggaacagaaaacgaaataccgcatgttctcttataagtgagagctaaacattgggtactcacggacataaagatggcaacaatagacactggggactattagagggggaatggagggagggggcaagggctgaaaaactacctattgggtactatgctcactacctattgggtactgtgctcactacctattgggtactgtgctcactacctattgggtactttggtgacagcatcatacaatataccaatgtaacaagcctgaacatgtatcccttaaatctaaaataaaagttgaaattactttttaacaaaagaaaattccacatatttatattgaaaccaagccaagctgtggtcttctgcaatgttataatcaccctgtaaagtcaatatacaaaatatattgtattaattttaacatttctaggctattcaggttaaattttgtgttccaaatctatctttcgtaatataagattcatattattctgatcacttctggctaaaccttaaaaagaattcccctatcaatacaaagaatattagttgggaaataatatatatataataaataataataataatatataacataatttaaaaaaattttaatggcaaacagttgtatctaataaagattctgaatcctggtcgggtgctgtggctcacacctgtaatcccagcactttgggaggccaaggcgggcagatcacttgagctcgggagttagcgaccaagcctgaccaacaggagaaacccagtctctactgaaaatacaaaattagtcaggcgtggtagcacatgcctataatcccagctactcaggaggctgaggcaggagaatggcttgaacccgggaggcagaggttgcagtgagccaagattgcatcattgcactccagcctgggcaacaagagcgaaactccatctcaaaaaaaaaaaaaaaaaaaaaaagnt

SEQ ID NO: 14554 - DNA, 970 bp, Homo sapiens
agtgaattaatgtaggaacagaaaacgaaataccgcatgttctcttataagtgagagctaaacattgggtactcacggacataaagatggcaacaatagacactggggactattagagggggaatggagggagggggcaagggctgaaaaactacctattgggtactatgctcactacctattgggtactgtgctcactacctattgggtactgtgctcactacctattgggtactttggtgacagcatcatacaatataccaatgtaacaagcctgaacatgtatcccttaaatctaaaataaaagttgaaattactttttaacaaaagaaaattccacatatttatattgaaaccaagccaagctgtggtcttctgcaatgttataatcaccctgtaaagtcaatatacaaaatatattgtattaattttaacatttctaggctattcaggttaaattttgtgttccaaatctatctttcgtaatataagattcatattattctgatcacttctggctaaaccttaaaaagaattcccctatcaatacaaagaatattagttgggaaataatatatatataataaataataataataatatataacataatttaaaaaaattttaatggcaaacagttgtatctaataaagattctgaatcctggtcgggtgctgtggctcacacctgtaatcccagcactttgggaggccaaggcgggcagatcacttgagctcgggagttagcgaccaagcctgaccaacaggagaaacccagtctctactgaaaatacaaaattagtcaggcgtggtagcacatgcctataatcccagctactcaggaggctgaggcaggagaatggcttgaacccgggaggcagaggttgcagtgagccaagattgcatcattgcactccagcctgggcaacaagagcgaaactccatctcaaaaaaaaaaaaaaaaaaaaaaa

SEQ ID NO: 14555 - DNA, 275 bp, Homo sapiens; identical to SEQ ID NO: 10132

SEQ ID NO: 14556 - DNA, 361 bp, Homo sapiens; identical to SEQ ID NO: 10133

SEQ ID NO: 14557 - DNA, 368 bp, Homo sapiens
atcttccctacttgcacgtccgtttataggctctctgcaagaagaaaaatatggctgtattttgcccgaccctgcaggcagtcagaccttatggttgtcttcccttgttccctgaaaatcgctgattttctgttctttttcaaggtgcactgatttcgtattgttcaaacacacatgttttataatcaatttgtacagttaacacaattatcacagtggtcctgagatgacgtacatcctcagcttacgaagataacaggattaagagattaaagtaagacaggcgtaagaaattatgaaagtattatttgggaactggtaaatgtccatgaaatcttcataatttatgttcctctgccatggctcca

SEQ ID NO: 14558 - DNA, 368 bp, Homo sapiens; identical to SEQ ID NO: 14557

SEQ ID NO: 14559 - DNA, 4625 bp, Homo sapiens
ccaggcgggccaggggtcgctgtactccctggaggccaccctggaggagccaccctgcaacgaccccatggtgtgccggctccccgtgtcaagaaaaccctggtgagtgatgaggctcttggggttccccgccccgaggccgagtaaagcagcagttggatgatgacgggtcaggtcaagacgcagggatctgaggtagctgctgccccaccttgagccacttcccaggccccgagggctggaaaccaagatgctatgaaggggaggatgccccggtgcaggccgtgcctcactgtccactgtgatggggtgattgccttaggggtggctctcatctgaggagcctccagctccatcttggccagatcttgctccccagatccagatccaggcccccagagcagcttcttcctctccctccagctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggtgaggagccctcagcttgaggagccctcagcttgaggagccagccgctgcctcatcacccttctcccttccctctggagtgggtttctctggtcagcctaaagactggtctgcctatccaggacttgcctgtgaagatggcttcaatcttcaagaactttgtcattacctataaccggacatatgagtcaaaggaaggtgaggacccagccttggctgtacctgttcctatcagaacaggactttccccccaacttggcaccttggtgtgtgggaggagaaagacaagaggcagtgtacctgttcaaggaccccataattcctgagctctccctaagccttcccagcctggcagccaccctgagtacctggccccttctcctaccttatcttcccgctcagaagccatgggtcttggccgggcgtggtggctcacctctgtaatcgcagtactttgggaggccgaggtgggcagattacctgaggtcaggagttcaagaccagcctggccaacatggtgaaaccccatctctactaaaaaaaaagtacaaaaattagccaggtgtggtggcgcacacctgtataccagctactcgggaggctgaggcaggaaaatcacttgaacctgggaggcggaggttgcagtgagcaaagattgtgccactgcactccagcatgggtgacaagcgaaaactctgtctcaaaaaaaaaaaaaagaagctctgcatctccatcactctggcagggtggaatggggcagaaggctggattttttgtgctggagagtccttgacaacatggcctttccccaccacctcttgtgggtggtgtcctttagaccccatttactgcttttgcacctgggaagtcatcacttcagtttggccctaaaagttgatcagacctcccactccatcacttgcatgtctggcccccacccctacctgctccccggggaaacccctgcctgctagccccaattgcccttccttttatctgcctggggtcgaacccctcctcttctgctccttggtcctcagaagcccggtggcgcctgtccgtctttgtcaataacatggtgcgagcacagaagatccaggccctggaccgtggcacagctcagtatggagtcaccaagttcagtgatctcacaggtagggatagtggccacagtcctcatggatccaggaagagacaggaccttgctcgcaaggcctctggtcaggtctggcttagaacactcttcctccccatgccctgcccacctttgcccgcagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccaggttggacccctggaagtgagggtgggacatgggcactgcactggggctgacgaaggggcccggctctgactccaactccacccatctcttgtagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggtatgcattaatggggtcaggaggggcaaccggagccacttctccctgtacaagaagttacttcataatgggggggagacatgagcatgagagttacacagaactgggtccaggtcttaatgctgacccagccaggcgtggtggctcatgcctgtaattccaacactttgggaggccaacttgggaagatcacttaaggccagaagttcaggaccaggttgggcaacatagcaagaccccatctctacaaaaaattaaagacattagccaggcatggtggcttgcatctgtagtctcagctacttggggggctgaggcaggaggatcgcttgagcccaggaggttgaggctgtagtgaggcatgtttgtgccactgtactccagcctgggtgaaagactgctgggatgagctcttggtgaggagtcagaagttggagttgagttctgtctctgccacttttcttgctggctactggtccctcctccccatctctcccagcctcagatgtgtcatttctagaatgaagacattcttcagaggggatggcctgtggcctggggtggacgaggaatgtgaaacctcgcgtagagggcttagttcatttctggctgtgaatggcaaatgggagcctgcccttctctactcacccccaccgttccccaggagggctggagacagaggatgactacagctaccagggtcacatgcagtcctgcaacttctcagcagagaaggccaaggtctacatcaatgactccgtggagctgagccagaacgagcagagtgagtgaggggcagggtgaggtgaggtcaggtggggccggggcctgggtgcctactgatgccaccccttcccatctcagagctggcagcctggctggccaagagaggcccaatctccgtggccatcaatgcctttggcatgcaggtgaggccctagccccactgcacatgccccatctcttgttgacctccccgacctcttcttggagtcgatcccctactccttctccacctccagttttaccgccacgggatctcccgccctctccggcccctctgcagcccttggctcattgaccatgcggtgttgcttgtgggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctgcactgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcccctggccctccagccgccatcctaccctggtgccctcaccagctccccctctcccccagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgag

SEQ ID NO: 14560 - DNA, 2895 bp, Homo sapiens
cagaagatccaggccctggaccgtggcacagctcagtatggagtcaccaagttcagtgatctcacaggtagggatagtggccacagtcctcatggatccaggaagagacaggaccttgctcgcaaggcctctggtcaggtctggcttagaacactcttcctccccatgccctgcccacctttgcccgcagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccaggttggacccctggaagtgagggtgggacatgggcactgcactggggctgacgaaggggcccggctctgactccaactccacccatctcttgtagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggtatgcattaatggggtcaggaggggcaaccggagccacttctccctgtacaagaagttacttcataatgggggggagacatgagcatgagagttacacagaactgggtccaggtcttaatgctgacccagccaggcgtggtggctcatgcctgtaattccaacactttgggaggccaacttgggaagatcacttaaggccagaagttcaggaccaggttgggcaacatagcaagaccccatctctacaaaaaattaaagacattagccaggcatggtggcttgcatctgtagtctcagctacttggggggctgaggcaggaggatcgcttgagcccaggaggttgaggctgtagtgaggcatgtttgtgccactgtactccagcctgggtgaaagactgctgggatgagctcttggtgaggagtcagaagttggagttgagttctgtctctgccacttttcttgctggctactggtccctcctccccatctctcccagcctcagatgtgtcatttctagaatgaagacattcttcagaggggatggcctgtggcctggggtggacgaggaatgtgaaacctcgcgtagagggcttagttcatttctggctgtgaatggcaaatgggagcctgcccttctctactcacccccaccgttccccaggagggctggagacagaggatgactacagctaccagggtcacatgcagtcctgcaacttctcagcagagaaggccaaggtctacatcaatgactccgtggagctgagccagaacgagcagagtgagtgaggggcagggtgaggtgaggtcaggtggggccggggcctgggtgcctactgatgccaccccttcccatctcagagctggcagcctggctggccaagagaggcccaatctccgtggccatcaatgcctttggcatgcaggtgaggccctagccccactgcccctgccccatctcttgttgacctccccgacctcttcttggagtcgatcccctactccttctccacctccagttttaccgccacgggatctcccgccctctccggcccctctgcagcccttggctcattgaccatgcggtgttgcttgtgggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcccctggccctccagccgccatcctaccctggtgccctcaccagctccccctctcccccagggttactactacttgcatcgtgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgag

SEQ ID NO: 14561 - DNA, 4193 bp, Homo sapiens
tcggcactttcaaagtcctggatgagctcggggggcgcgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggtgaggagccctcagcttgaggagccctcagcttgaggagccagccgctgcctcatcacccttctcccttccctctggagtgggtttctctggtcagcctaaagactggtctgcctatccaggacttgcctgtgaagatggcttcaatcttcaagaactttgtcattacctataaccggacatatgagtcaaaggaaggtgaggacccagccttggctgtacctgttcctatcagaacaggactttccccccaacttggcaccttggtgtgtgggaggagaaagacaagaggcagtgtacctgttcaaggaccccataattcctgagctctccctaagccttcccagcctggcagccaccctgagtacctggccccttctcctaccttatcttcccgctcagaagccatgggtcttggccgggcgtggtggctcacctctgtaatcgcagtactttgggaggccgaggtgggcagattacctgaggtcaggagttcaagaccagcctggccaacatggtgaaaccccatctctactaaaaaaaaagtacaaaaattagccaggtgtggtggcgcacacctgtataccagctactcgggaggctgaggcaggaaaatcacttgaacctgggaggcggaggttgcagtgagcaaagattgtgccactgcactccagcatgggtgacaagcgaaaactctgtctcaaaaaaaaaaaaaagaagctctgcatctccatcactctggcagggtgggatggggcagaggctggattttttgtgctggagagtccttgacaacatggcctttccccaccacctcttgtgggtggtgtcctttagaccccatttactgcttttgcacctgggaagtcatcacttcagtttggccctaaaagttgatcagacctcccactccatcacttgcatgtctggcccccacccctacctgctccccggggaaacccctgcctgctagccccaattgcccttccttttatctgcctggggtcgaacccctcctcttctgctccttggtcctcagaagcccggtggcgcctgtccgtctttgtcaataacatggtgcgagcacagaagatccaggccctggaccgtggcacagctcagtatggagtcaccaagttcagtgatctcacaggtagggatagtggccacagtcctcatggatccaggaagagacaggaccttgctcgcaaggcctctggtcaggtctggcttagaacactcttcctccccatgccctgcccacctttgcccgcagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccaggttggacccctggaagtgagggtgggacatgggcactgcactggggctgacgaaggggcccggctctgactccaactccacccatctcttgtagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggtatgcattaatggggtcaggaggggcaaccggagccacttctccctgtacaagaagttacttcataatgggggggagacatgagcatgagagttacacagaactgggtccaggtcttaatgctgacccagccaggcgtggtggctcatgcctgtaattccaacactttgggaggccaacttgggaagatcacttaaggccagaagttcaggaccaggttgggcaacatagcaagaccccatctctacaaaaaattaaagacattagccaggcatggtggcttgcatctgtagtctcagctacttggggggctgaggcaggaggatcgcttgagcccaggaggttgaggctgtagtgaggcatgtttgtgccactgtactccagcctgggtgaaagactgctgggatgagctcttggtgaggagtcagaagttggagttgagttctgtctctgccacttttcttgctggctactggtccctcctccccatctctcccagcctcagatgtgtcatttctagaatgaagacattcttcagaggggatggcctgtggcctggggtggacgaggaatgtgaaacctcgcgtagagggcttagttcatttctggctgtgaatggcaaatgggagcctgcccttctctactcacccccaccgttccccaggagggctggagacagaggatgactacagctaccagggtcacatgcagtcctgcaacttctcagcagagaaggccaaggtctacatcaatgactccgtggagctgagccagaacgagcagagtgagtgaggggcagggtgaggtgaggtcaggtggggccggggcctgggtgcctactgatgccaccccttcccatctcagagctggcagcctggctggccaagagaggcccaatctccgtggccatcaatgcctttggcatgcaggtgaggccctagccccactgcccctgccccatctcttgttgacctccccgacctcttcttggagtcgatcccctactccttctccacctccagttttaccgccacgggatctcccgccctctccggcccctctgcagcccttgcgtcattgaccatgcggtgttgcttgtgggctacggaaccgtgagttccgctgcctgtcctgcatccagccaggccacagcgaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcctgccctccagccgccatcctaccctgtgccctcaccagctccccctctccccagggttactactacttgcatcgcgggtccggggcatgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgag

SEQ ID NO: 14562 - DNA, 1198 bp, Homo sapiens
gggagagacccagagagggatctttattcagaagcacttggctggcttttctcttaggcccttgctccgagggacggatgggatcagccacagggtgcatcctctctccatcttgcatagagaacctcagtggttggggtcaaaggtcgctctccccatagagggcactggagaaggccacgtagtccagggctccagccggggccccggatcccttgtagggcaccatacggcggatgcagtactcggcctgcttggcagggagctcgcgccgcagctcctcgggggtgatgtagttctggggagaagaggcgttgaggacccacaggtcccgtgccctgccctagcccaccagcccctccaccgcctgggactcaccttgtctcctgccaagatcttgaaggaagctacaacttgctcagtcgtgtcagtctcggctgtctctcgggtcatgaagtctatgaaggcctggaaggtcaccaccccagctgcgttggggtccaccatggtcatgatgcgagcaaactccacttccccctgcagggatagaggccaggcactatgcccatgagcactaaagccaggagggctcccagtgtcccctcctggggactgtccaacctcagctagcagagccccagtaacaagggagttcccttcctccagagaccttagccctggctgtaggaagtcctttatggtaggctgaaatctgcatcctacccacagcaggaagcagatttgctccctggtcctgattttttttccagggccacacccgtttctgtagtgctgtttccctacaggtaaaaatgttgcaagctcagactttgggtccacacagaactgggtccaagtgagttttacctccctgagccttgctagcccctgtgtggatgtagtgaagatgcaggggatggtgtatgtgaagatgggaggtgcacagtaggtgatcagcacagaggagggggtactttgggactcctgggaaggagctggggagctctcaccaggtcatagcccatggagatgaggcaagctcggaagtcatcaggctccatcatcccattccgcttctgtagggggtgagtggttatcaggcttggtctccagcctccaccagcccccaagtgtcttaccccacagggccaggcccctgctgaccctgtcaaagtggttgaaggatgctcggaactcg

SEQ ID NO: 14563 - DNA, 3073 bp, Homo sapiens
gggagagacccagagagggatctttattcagaagcacttggctggcttttctcttaggcccttgctccgagggacggatgggatcagccacagggtgcatcctctctccatcttgcatagagaacctcagtggttggggtcaaaggtcgctctccccatagagggcactggagaaggccacgtagtccagggctccagccggggccccggatcccttgtagggcaccatacggcggatgcagtactcggcctgcttggcagggagctcgcgccgcagctcctcgggggtgatgtagttctggggagaagaggcgttgaggacccacaggtcccgtgccctgccctagcccaccagcccctccaccgcctgggactcaccttgtctcctgccaagatcttgaaggaagctacaacttgctcagtcgtgtcagtctcggctgtctctcgggtcatgaagtctatgaaggcctggaaggtcaccaccccagctgcgttggggtccaccatggtcatgatgcgagcaaactccacttccccctgcagggatagaggccaggcactatgcccatgagcactaaagccaggagggctcccagtgtcccctcctggggactgtccaacctcagctagcagagccccagtaacaagggagttcccttcctccagagaccttagccctggctgtaggaagtcctttatggtaggctgaaatctgcatcctacccacagcaggaagcagatttgctccctggtcctgattttttttccagggccacacccgtttctgtagtgctgtttccctacaggtaaaaatgttgcaagctcagactttgggtccacacagaactgggtccaagtgagttttacctccctgagccttgctagcccctgtgtggatgtagtgaagatgcaggggatggtgtatgtgaagatgggaggtgcacagtaggtgatcagcacagaggagggggtactttgggactcctgggaaggagctggggagctctcaccaggtcatagcccatggagatgaggcaagctcggaagtcatcaggctccatcatcccattctgcttctgtagggggtgagtggttatcaggcttggtctccagcctccaccagcccccaagtgtcttaccccacagggccaggcccctgctgaccctgtcaaagtggttgaaggatgctcggaactcgttgagctgctcctggctcagtcccttggcgtctcgggtcagtacctggttctccacttcattgatggtgcgggcaatggaggtgagcagctgctcccagcccacgcggatgtgctggcggtcaggggacaggccactgtcagtgggcggccagtgcctggccactggctctagctccacatccagttcactgaatgaccctgggcaagtcctccccctcactgggcctccatccccatctggaggctccactgagtaacccacccccaccccagcagtccttcctgtcttttgataaccagctatggccaatcttggcctggttttggacggctttgtgactctggaagggtcactttccatcgctgggtcttaagggacctggccaagctgaactggggactctgctgggacacacatgctctgtccagctgtgatctccctgggcctcctcagccagtgctgcctccccactctcctgagagggtgtgatcccacctccatgctgtagacggtgtgcttattgtcgaacaccaggctctcctgcagcagctggtggtcaccctccagccggtcaatgttagtcttgtagttgataatgttctgctcctgctgccgtagcccagccatctgctcctccagagagccagctagccctgctgccagccgccccacttcctgcaggggttcccaggcagcatgagggctcccaactccctgtggcccagccctggccccatccccccaggttggacccactatcccagcccttacctccaccttcgcctggatccagggtccaatggcattggcctgggccgcaaactgtcgccggagcctctcgtttacctgctgccgtgccagctcctcctgcagtgtctggtcacagctgggcaccagctttcggacctgggaggagggcagttatgccagagccagctctgggggctgggaaatggctttaggggagatgggctccagcccctcaaacctcagcccctgttgctttgagccaacttgtctgggatatacgagaaagctcttgggcaagtcactaacccatgtgggcttcagttttctcatctgcaaaatggggctgatggcatcatttactaatatgggtggatttataaaagatgtccacacacaaggcttaattctacttcacatcagtcctgacaggagaatgctgctgttacagctcatcatatacagatgagcccgagacaggcaaggcgatttatccaatcccacgtggagtctgtggcagaccccacatctgaagatggactttattctccatatcttgggccacccgagatttcagggtggtcacagtatgcaggagggggtgggaggaaggctgcaggtggcactgaccatatcccacttggtgttgatgtcctgcgggctgagggtgatgtagggattggtggagcagggccgcagcccatacgtctggcagatcttctggatctcaccctggatgcccatgatggcacctcgctctcagtcagcctcgggcagtgttgccttgaactgatcgtgcgctgtcagcaggctctggggacgacaggcaggaagtgtcagctggtgtcccccacttaccacaggcaacagaaagggcagcagtgtgccccaggccacccaccagtcctgggcagtcctgacacaagaaccccggcctcctgtcttccagcccagcactcgggaactggggttttcctcccatccctatgccccaggagcctaaagttgtgggtggcagaatttggggccagctttcctgtcatcctatccatcccctgcaaccctggcacccacctgggtctcctccacagagtgtaccagccacacgtcctgcaggtcctccacg

SEQ ID NO: 14564 - DNA, 4463 bp, Homo sapiens
  misc_feature (2621)..(2621): n equals a,t,g, or c
  misc_feature (2631)..(2631): n equals a,t,g, or c
  misc_feature (2753)..(2753): n equals a,t,g, or c
  misc_feature (4121)..(4121): n equals a,t,g, or c
  misc_feature (4182)..(4182): n equals a,t,g, or c
  misc_feature (4192)..(4192): n equals a,t,g, or c
gggagagacccagagagggatctttattcagaagcacttggctggcttttctcttaggcccttgctccgagggacggatgggatcagccacagggtgcatcctctctccatcttgcatagagaacctcagtggttggggtcaaaggtcgctctccccatagagggcactggagaaggccacgtagtccagggctccagccggggccccggatcccttgtagggcaccatacggcggatgcagtactcggcctgcttggcaagggactcggccgcagctcctcgggggtgatgtagttctggggagaagaggcgttgagcccacaggtcccgtgccctgccctagcccaccagcccctccaccgcctgggactcaccttgtctcctgccaagatcttgaaggaagctacaacttgctcagtcgtgtcagtctcggctgtctctcgggtcatgaagtctatgaaggcctggaaggtcaccaccccagctgcgttggggtccaccatggtcatgatgcgagcaaactccacttccccctgcagggatagaggccaggcactatgcccatgagcactaaagccaggagggctcccagtgtcccctcctggggactgtccaacctcagctagcagagccccagtaacaagggagttcccttcctccagagaccttagccctggctgtaggaagtcctttatggtaggctgaaatctgcatcctacccacagcaggaagcagatttgctccctggtcctgattttttttccagggccacacccgtttctgtagtgctgtttccctacaggtaaaaatgttgcaagctcagactttgggtccacacagaactgggtccaagtgagttttactccctgagccttgctagcccctgtgtggatgtagtgaagatgcaggggatggtgtatgtgaagatgggaggtgcacagtaggtgatcagcacagaggagggggtactttgggactcctgggaaggagctggggagctctcaccaggtcatagcccatggagatgaggcaagctcggaagtcatcaggctccatcatcccattccgcttctgtagggggtgagtggttatcaggcttggtctccagcctccaccagcccccaagtgtcttaccccacagggccaggcccctgctgaccctgtcaaagtggttgaaggatgctcggaactcgttgagctgctcctggctcagtcccttggcgtctcgggtcagtacctggttctccacttcattgatggtgcgggcaatggaggtgagcagctgctcccagcccacgcggatgtgctggcggtcaggggacaggccactgtcagtgggcggccagtgcctggccactggctctagctccacatccagttcactgaatgaccctgggcaagtcctccccctcactgggcctccatccccatctggaggctccactgagtaacccacccccaccccagcagtccttcctgtcttttgataaccagctatggccaatcttggctggttttggacggctttgtgactctggaagggtcactttccatcgctgggtcttaagggacctggccaagctgaactggggactctgctgggacacacatgctctgtccagctgtgatctccctgggcctcctcagccagtgctgcctccccactctcctgagagggtgtgatcccacctccatgctgtagacggtgtgcttattgtcgaacaccaggctctcctgcagcagctggtggtcaccctccagccggtcaatgttagtcttgtagttgataatgttctgctcctgctgccgtagcccagccatctgctcctccagagagccagctagccctgctgccagccgccccacttcctgcagggggttcccaggcagcatgagggctcccaactccctgtggcccagctctggccccatccccccaggttggacccactatcccagcccttacctccaccttcgcctggatccagggtccaatggcattggcctgggccgcaaactgtcgccggagcctctcgtttacctgctgccgtgccagctcctcctgcagtgtctggtcacggctgggcaccagctttcggacctgggaggagggcagttatgccagagccagctctgggggctgggaaatggctttaggggagatgggctccagcccctcaaacctcagcccctgttgctttgagccaacttgtctgggatatacgagaaagctcttgggcaagtcactaacccatgtgggcttcagttttctcatctgcaaaatggggctgatggcatcatttataactaattatgggtggatttataaaagatgtccacacacaaggcttaattctacttcacatcagtcctgacaggagaatgctgctgttacagctcatcatatacagatgagcccgagacaggcaaggcgatttatccaatcccacgtggagtctgtggcagaccccacatctgaagatggactttattctccatatcttgggccacccgagatttcagggtggtcacagtatgcaggagggggtgggaggaaggctgcaggtggcactgaccatatcccacttggtgttgatgtcctgcgggctgagggtgatgnagggattggnggagcagggccgcagcccatacgtctggcagaacttctggatctcaccctggatgcccatgaaggcacctcgctctcggccagcctcgggcagctcgttgccttgaactgatcgtgcgctgncagcaggctctggggacgacaggcaggaagtgtcagctggtgtccccacttaccacaggcaacagaaagggcagcagtgtgccccaggccacccaccagtcctgggcagtcctgacacaagaaccccggcctcctgtcttccagcccagcactcgggaactgcggttttcctcccatccctatgccccaggagcctaaagttgtgggtggcagaatttggggccagctttcctgtcatcctatccatcccctgcaaccctggcacccacctgggtctcctccacagagtgtaccagccacacgtcctgcaggtcctccacggcaccatccagccagttgttgaagggcgcgcggccgggcaaactccagttgcagctggtcaatggtctccaggagcttctccatccgctagaggtgggaggcgtagtgggtcagaagcctgccctgcagacctggcctcacccacctacccaccccccagctccccggcccccagccccacctctagcgcatcccgcctcttctgggtcagggtgcccaggttgtcccactgatcgcagatggcctggcagcggctattcactgaggctgcctcgtggtagtccagctcactgggagcgagaagtagggcgagtgtggggccagccccagcccagatgtcctaactgcactcccagggctggaacctgctccccggatgggggtgaaggcgtgcgggagccagggcaggtggtgggtaaagctgggtgctttccaagaggggcggtaccagcgcatccctctgggcaggtgggcgcccgcgggtccttagctgcagtccatggaggtgcttgggtggaggggcggggttgcgcaagaaggggcgggttcatgggagggggtggccaggccaaggctgatggggagggtttggagcagtaagccgggtgaagagagcgggcaggttagagggcaggtcacggagtgagacaggtcaagcgccagtgggaagagtgtgagcagcagagcggggtccggaggtgggggtggggttccaggaggggcggagcgaatgggacctgggtaccacggcgggttacagaacccaggagagcctagtgtcttgagaagggcaatggggatcagggtggggctcgccaccgggggcggggccgggggtgttgggggcgggccccgcgagccccgcctacttgagctcctgggccagcgcggcaatgtgctccacgcggtcctggtgcgccgccaggtcgctctcaaagcctcgtggcgccgcagcaacgcccgcacctcctgtagcaaagccgaatcgtagtcgcgctggctcagcatctcctcctttcctgctcaaagagatgccggctccggtcncccagtggcggcaggggcaggggtgcgcggcgggctgcgtgaccatgaagcgtctctgctnaaggtggcgntcgcaccggcctagctcgtcctagggatttgctctgcggcgtcggtgtaataacgtaggtgaaagtcctcttccgtggcgtgatccgcaaatgacatcagcgtcccctgagcgagctacgtccagggggcccttggtacagttttagcataatttgaccttaaaatagctctcaacgattctgtaacccccatgagcccctgacccggcctcctttgttcactacagaaatcctcgacagaacaacgaatggatgtttctatccagagtaa

SEQ ID NO: 14565 - DNA, 4606 bp, Homo sapiens
gaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtgaggcacccgggtcaggcggagtcccggagtcattgtccttgagtcggggagctggggcctgactcgggggaggggctgcccagtgtggaggggctcccaaatgggggagcagagcgttccgagacaggagtattactgctcctgagccccctgtgtcccctcaggatcaggttaggcttcagtaggatccagcccccatccccactcctaatgcacacacgtggacgcacatgcacttaccctctgaggcaggtggaaccagcagcatgagaacctggagaagctgaacatgcaagccatcctcgatgccacagtcagccagggcgagcccattcaggagctgctggtcacccatgggaaggtaccccgaggtcacaggcagggttcctgccttcccccatacctcacctactctacccctccggagtcccctgtgtgcccttcccctctggcctggtacacctgttctccctgaaggacaaagaggaatgtgttacatgtttcattttgtatccctattggacaggactctggcacaccaggctgggtgcagggcatgagttgattagggagaaagctgtaggtcctagaacagcttaggcttcaaggggaaggcccaaatgctaaaggcatctgtgaattgactgtaaggctggtggtggggaaggggtggggaggggttggggagggcgggagggaggggagataacctaactggaggtggaacttcggcatggaaggaagcagccttcccaacatgaaagggggaagttagaaaccagggagatgcctggctggaacatggaccagggagtgtcaccagcagatgacctgagatatcaattgaccaaaaaaaaaaaaaaaaaagccgggcatggtagctcatgcctgttatcccagcattttgggaggccaagacgggtggatcatctgaggtcaggagttcaaggccagcctggccaacatggtgaaaccccacctctactaaaaatacaaaaatttgcagagcatggtggtgcacacctgtaatcccagctactcgggaggctgaggcaggagaatcgcttgaacctgggaggcagaggttacagagagccaagatcatgccactgcactccagcctgggtgacaagagtgaaactccgtctcaaaaaaaaaaaaaaaaaaaagaaaggtcctttgcaaaagaaagatggaactcatactaggggataggataggaacagggcactgtgaagggtcctgagtaggagtgaggccaaggcacacaagagctttggaggaccacagacagggactagagggagggcatgaggagaagggctggcttgaaagggatgcctgaatgggcgggcagaggataagggtgcaggtgcaggcagggcaaggcagtctgggaactgggcaggagccagtcacataagcatgagggacatccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgagctgggcccctggttcatacctcttctcactccttcagagggctctggaccggggaggagagctggtagcccctatcccttcctcaggccctgtccttctctttatctgacaggtgcaccacgaggcctccatcatcaacctcttggagacagtgttcttccacaaggtgagggactatctctgcccatgggccacagttccgggtcagggcctggcaggaagggagattgtgtctgtgtggggaaggcatcagacacagaaagtttccctcctccttttcccaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacggg

SEQ ID NO: 14566 - DNA, 6750 bp, Homo sapiens
ttttcagtcattttttacaaattttttacttttttctctcctaaaatttctgaacatacagtacaagtatgagctgccttgcaggagaggcagtcttgcagccccagcttcatccagacacatgatgcctatgttcctctgggatgacagagaaaggggaaggaaatgggaggcactccagcatgaggagcaggaattcacacacgggcctccaaatgcccaactgtcccagtgcctgaggtgtcccctgactcagctgagagagttcaacaggtccctaggcccagctcctacatggaggggcaaatccaggcttcccctaggctgggaagagctcatggttggatcctcttgcggtataggtaggcattgctcacctggttcataatgaccaagctggtgaggacagggcataatacagccaggtaccaggctgcaccagtgacagaggcagtgaaccagagtgagcacatgcccagcaagaggctggcactacccagcaggtagcccaccagcccagaagtagcatggtatagcttgagcttcgccaggggccatcggggcagcagcttggggtagagcagccccaccccacctgagcactgcagccctgcccacagcacagccagcagccctgcctgcccatgccgcgtaaccaggtgggctttgccaagctgctctttgtggaggatgacaaggccgaggcccagcagtgcacacagcagggccagcagctgcagcacccagtggcagcgtgctcggcctttccgtgagagggagtgcagcagcgaactctcaggagaaaacaccagtagtgcctcggtcatcaggaaggagaactgaggaaacaggggatgggaagctcaagtgagggtgctgccccagaagaggagaagagggctttatgtaacccttagctgccagtgagtctgggctgattcccctttttctttctctccccactgacaagactatccatttggtggggcaagagtggaaaaccccatctgggatgatatatgtgccctgaataatctccacacttcctcctaggtgccagtctgaaatgtcatctgtcgtatgttaccaagcaaacacagggtttgagatgtggcagttataaatgattcacaagctttgtttccctaacgtggggctggatacaatttcttggcaagagctggccacatgggtgcactgtttcagggaaagttaggtgcatcaccagaaattaaagtaaaaagggacagaggtacatccaaatgcaatgtctcagctttctgcctagaggtgggtgaagcctcattgtgcttagacaaatcttacccatttgacctgggtcctgggtcttcattactctgattcaagtctctttttttttttttttttttttttggagatagtctctctctgtcacccaggctggagtgcagtggcctgatctcggctcactgcaatctccgccttccgggttcaagcaattctcctgcctcaggctcctgagtaactgggattacaggcacctgccaccacacccagctaatttttggttttttggggggtttttttgtttttgggtttttttttttttttgggacagagcctcgctctgtcgcctaggttagaggttagagtgcagtggcgcaatcttggctcactgcaacctccgtctcctgggttcatgcgattctcctgcctcagcctcccgagtagctgggactacaggcgcgtgccaccatgcccggctaattttttgtatttttagtagagacggggtttcaccatgttggccaagatggtctcgatctcctgacctcaggtgatgtgcccgcctcggcctctaagtgctgggattacaggcatgagccaccgtgcccagcctcaagtctgaaatatataccatgggcaggagtagttggagcatgcaactcttccaaacagatattaaatgtggacaaagattcagaggctgccagggccaccaaccatgcccatgctcccacccctaagaactgcccaggcccactacttacagccaaagacataagcaccgggtgccaggagaacaggcctggaatgagaagaggaggcctcatggggctgaggcaagaagaaaccagccataccaatccttaagggttgaggaataccagcagcccatcacccaaggaggtgctgccaaactgtgagccccttcttgctctgcaacaagctgaccccacacctatcctctcttcctggcctcttcctggatcagaggccatgctttgccactcctctggcagtcctccctccttcccttacacctcctgagaggcagccaaatggagcacccagagaaggaaagacaaaccaggaattctgtgtgccctggccatacctacctgctccacctcactcatcgctccagcacagaattccctcaaccagccaggcctgttcccggaagtcccactgcccttcctccccaggaacagtggcccttcccttcccagaagtcagctatgaattctacttactggagccaggcctggcaagcacagccacaaagatggtaaagcccagggccacaaggtgggcggcagcgccagaagcagtacgcagagctcggtagatgtgtgactcggtctccgcagaaagggccatcgtcagccgtgctagtggttgtagcctgaaagcatagtagcgtgggccaggatctcaggtgcccactgttcactcctcactggagaaaaggctgcaaggcaggaatgccaccctcttccaataagttatggtaggaaagaacagtaccaagaccagcaccaggaatggtcacaacatgccagtcgacggccggcggcctgtcaacgtgtacccatgtctgaactggtaccaatcgctggcccgccttccaggtaggaggcgcaaagccatgtaagactacaaatcccagcgtgtaccacgccgtcgccggcagtagagccagctgggagggcgcggagcactatggaaattgtagttccctgctgcggtcccagttacagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtgtgagaccctagctcggggtgagcggtgggtggcaggggttgtcccaggaggaggaagggacaggcttgggggcctgactgtgttccaattatccagcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagaggtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagctagagagcagcttcgtgtccatggaggagagcaagcagaagttggtgcccatcatgaccatcttgctggaggagctaaatgcctcaggccggtgcactctgcccattggtatggccagcctctgcaaggacagcagaggggtagaggagagatgggaaagtgaacccagctagtcagggagaagggcaagactcatgaacacattggtgggcaggaaatagccatgggctgaggtgcccatgtccagggtccaatgcatgatggagctgggactgggggtagggggaaagcagagctctccagctctgccccttgggcaattccttcccctttgtgggcctccgtttctcactccataaaaagagaaagattagccctacccagaggcacctgcttgccccaagggatgctgggaggcctggatggtaattgaggacctcttggaagaagtggcactgaggatatggatggggccccctgcagatgagtccaacaccatccacttgaaggtgattgagcagcggccagaccctccggtggcccaggagtatgatgtacctgtctttaccaaagacaaggaggatttcttcaactcacagtgggacctcactacacaacaagtatgccatccctccctgggtatcatcacctggggctggccacagccctggcctcatcctgtttcttctgaccttgtcccactctgcccagatcctgccctacattgatgggttccgccacatccagaagatttcagcagaggcagatgtggagctcaacctggtgcgcattgctatccagaacctgctgtgagtgggcctacagtcatacctgggacaaggtcaccagccagggaagacctcaggggccctgggtgtgagggttgggaaggcatggtcctcagaagctgagcacagctctctctctcaggtactacggcgttgtgacactggtgtccatcctccaggtaggtgagttgggtttggttaagtggagagtggatcatgtggctggaccagaccagggctgtgtcagcttcccaagcccctcactcaggcccctatgccttctgctaccctctagtactccaatgtatactgcccaacgcccaaggtccaggacctggtagatgacaagtccctgcaagaggcatgtctatcctacgtgaccaagcaaggtagtggtgggttctgggggaagccatcttggggagggcagggccacatgatgagctgatccctggcacccacagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggtggaggcaggcgggcagtcagggtgggttcagggcagggtggccaggccaaggccactgacctctcctccaccaccccacccaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacagcctttattgagtgctgtttctgggccagccgtgggagacccagcagtgaatgaaatagccacgagccgtgggctagatcgccatctggtgggcaggaccgacaatcgacaaataaaagtgccggttaattacaaaaaaaaaaaaaaaaaaaaaaaaaaa

SEQ ID NO: 14567 - DNA, 10273 bp, Homo sapiens
cccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaacaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaagtattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgta

SEQ ID NO: 14568 - DNA, 13361 bp, Homo sapiens
gctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggctctctttgtatgggacgggggtcagggaaagaagattttctgttaaagtgtgagtaggagtttgacaaactggaaggatggtggcaaagagggctttctaaagagcggtggcagcaagtgtgaatgctggggttcctggaaagagaccgcagttgtgacagcatctcgagtgagtggacctgcgtcgccccaccacacgcacacagaaggaggagctgaaacggggattggcggaagtcagtttggttttagacctgtttaattcgggacaccttttgggatatgtagatggatggctttaacggacggttgggtgcccagatatgcagctcgggagcaaggtctggctggaggtgcagacttgggaatctcaacttgtggtagtgactggctgaagttactcaggaaaaaggtttatttttattttattttttgagacggagtctcgctcgtcgtccaggctggagtgcagtggcgcgatctcggcttactgtaaccaacctctgcctcctgggttcaagccattctcctgcctcagcctgccgagtagctgtgactacaggtgcccgccaccacgcccggctaatttttgtatttttagtagtggtggggtttcaccatgttggccaggctggtctcgaactcctgacctcaggtgatccgcccgccttggcctctcaaagtgctgggattacaggcgtgagctaccatgccccgccaggagaaaggtttagattggaaatagaaagtcatgtgtggaatgaaagtgacaacacccacattggtctggcttgtggggagccagcaatggagaatgagaatgaccagttagcaagggcgagagagaagggtttcacggacttcagaagagtgtttagtaatgttagaggttgcagcatggctaccatatgggatgctcaaccccactagaaagtgccctcaagctccctcaatccagccccagtcattggggaagtagaatttgaaggaggttcagcaagttccttagcatgtacagcagtggacctgtgaggcaggagcacccagactgcagctccgactttcttttttcttttttttttttttttttgagacggtctcgctctgtcgcccaggctggagtgcaggggtgtgatcttggctcactgcaacctccgcctcccgagtttaagcgattcttctgcttcagcctcccacgtagctggaattacaggtgcctgccaccacgcccggctaatttttgtatttctagtagagactgggtttcaccatgttggccaggctggtcttgaacttctgacctcatgatccacctcccttggcctcccaaagtgttgggattacaggtgtgagccaccgcgcctggcctctgactttcattctgatctctccttgcagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctgtatgaggaccctgtgggtggcggagaggggaaagcctgctgaactgtcgcttcaggctcactctaattcttatccccctctcttcccctagatgtgactccagccacatttgaaacccctgaggtgcatgcaggcactggagtggtgggcaacaagcccaggccccgcggccgaggcctggaggatggtgagtgagggtgccctctttaagtcacatggtcaggattgcctgggaatcttagcctgtgaggccctgagggggtggtccagagggctgcaggccacatcttgttcctgaggggtcttgcgtaaatagcagcctgtgaagtcaaaggacattggtctaggtggtagaacatctgggtccagctcccacacatggctcgcctctgtgaaatgggactctcaccagctcttgctggcttttctgctgtgttccagccctgccctgtgggcttcatggatgttggaaggccccttttgttactatcctgaagatgcctcagggcctctccatttgtttccttcatgttggtcacttcccagataactgcatggctcactgtgtttcttcctgtagatctctgcataggtgttacctgttcagagaaacttttcttgacctgccagtgtgaagtcacaacaccactggtgctctgtggcttccagcctggctttggtttttcatcacaagacattttattttatttaatttcattttatttttaattttttgacacagagtctcgctctgtcacccaggctggagtaaaatggtgtgatcccggctcactgcaacctccacctcccaggttcaagcaattctccctgccttagcctcccaaatagctgggattacaggcgcctgccaccactcctggctaatttttgtattttgtagtagagacgaggttttgccatgttgtcccggctagtcttgaactcctgacctcaggtgatctgtctgcctcggccccccaaagtgctggtattacaggtgtgagccaccgcgcctggccaagacataacgttttaaaggcatttctgtttatggtctctttccctaattggcatcccttgcacaagagcagaagctttgttttgctttcatctgtatgctccgtgttgggaacagcacatgtggtgttgtgggccttgcacagatacacatggaacagatgaaagagttgtcatcttcagcatgtttgctgggacacacagctctatatggtaacatcgtgacttgatgggggagtcggtttaggaaagggcactccgagtcctgttgaatgcaagtgttctgcacgccatgggacttctgcgttgtcaggccctcttttcatcagtagtagaatgtcagtgcatgtatagacaaacgagacactctttcttatcagtttgtagactccactgtgctggagtagcacagatgtgttgtgtgtttgcacaaacatgcaaacatgatactttttgctttacaatccagctttttcggccattaacacagtccttgttgtccttgaagcttgattatctgttgaaatgtagcttgtgcatcacagggcaatttgtagatttttttcttctccttttttttttttttcctatagagatgaggtttcattatgttgcccaggctggttttaaacttctgagctcaagtgatcctcccaccttggcctcccgaagtgctaggattacaagtgtgagccatcatgcctagccagtttgcagattttcaatacctgtacacctacatgccagtaaatataggaatccttttcagaacctaagtggtaggaaccatcatcatgtttacaggtgaggaaactgaggctcagaaaggcagtcacttctgcaggtctcagagatggtcagggtttcacttcttatctctctgagatgaatagagtttctgacccctgtcctcatcccgtgggtcttgagcttgtagccactgtgccttgtgcatagcctcacgtgtagcaggtggtcaggactgtcactagacttgaaggcagagctctccaggtggccccaccgaagtttgcaccaccacacgcagcaccagggcaccacctcagtgggagtaccactttccatggtggcagggttggtcggaggggggggtgtttggggttgtggcttagcacctgtgaggccccatccagaggactaagtcatatgagatccctggaattggggctcgctctcaggtcaggatgattaggcgatgaccacccacctgtagtacaggtaccaggaagagaagagtgggtaaggtaaggaaatcctagggagtgagggagagccccagggatttggaggcctggcacccacaggcctggcaccactttggtgggggaggagcctgcctgtgatcacgagctcttgctctaacacctgtattgctttctccagtctgaatcagaccacgtaattcccttggcatccagcacatgagcagagctggccctgaatctgtagggtaccacctgagggctctctgggcagtcagggtgggtggattctgcccccgtggggagtccttggcagtgtgggctttcatgggcagaagccaggaccaggggagaggattccagccctgcatgttgggggctatgattcctgggcctgggtgtcctcctctttcctgactgcaaagggtgctgtgttcctcctcccgcaacccctaagcaggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaaggtgtctctggggtctggggtgtcacataggcgtaggcaccctctgtggtggttggggagccccagggccatgggtacaatgcccaggggcatctctgaccatcacttttccccatgtgattgcagaggcagaaagataatctcgaactcccgtcagcagagcaccaggccatcgagagcagccaggccagtgtggagacctggaagtacaaggccaagaattccctcatgtactatccagagggtaagtggcgggcctcgcagccaaatggggaggtgttgggtagagctgtgtgtgtctggctgtgtttggagcagccttccaggtgtgtatggccgtgcccccttgcagtttgggcttctgatgggtactggtctgtctaagggtggacaggtctgtgtgaggtcagcagtgagtgagaccctctccagcggcactggggcctgcgttctgctcaatgcttttgttcatctgggagtgacttggccgagaagcgagctcctcatgctccttaggctgctgcccttctgacacctgctgctacctttgcttcgtctgccaggtgtccctgacgaggagcagctgtttaagaagccccggcaggtggtacataagaacacgcgcttccttagggaccccttcagccaagccctgagcaggtgccagctccagcaggcagccgccctcaatgcccaggtgagcaggcgggtcagcagggccgcatgggccaggttggacagggctgcctgggggcaggcatgatctctcccatctctttgagcttggcagagctcagtgagtggaaccatctggggccctgtgcggcaggatcctgagtctttccttggccccagtgggcttccattgaacactgccttggtcacacacgttctgtaggtccagatctgtgccagctcccttgatggcaggggcaggagagaaaagggactgctgggagtgagcccaggctggcagctgcacgcccacacaccgggcagggaagccagagagccgcagagggagcccagccccagggggtggctggggtgggacaggccctgggttggcagagagcagaggctttctgagtctgggagcaagacgagtagatactctctgatggtgactgtggcagtcacagggttgaagtggggaaggcaggaagagactagagcataagcattgcctgtcatcagcattgcctgtcatcagcattgccccctgcaggggcctggcgtcagcatcctctggagttgctgggataggcgcagctcgagtggaggccctggcacctccctggatgggaggagggggctttccttgcttgggtacccactttgacaggccctcaaggtcttttggggggttggggcaggggccctccctctctttctccaagaaggctgccaaccccagagccccagccttgccctgaggagaggaagtgtttccagcatgttcccacgtgtttgcccaccggccagctgtcgagcgtgggctgcggtccccctgatgccagcctctctgcttgttccagcacaaacagggcaaggtgggccccgatggcaaggagctgatcccccaggagtcccctcgagtgggtggatttggatttgttgccactccttcccctgcccctggtgagaaaagtgcccactggcaagtgggtctactgctgggactccctgggggaggtgggcttctcagtcggccctggccactcctggcctctacctggcctgccccacaccttgtgtaactcagggacctggtctcctgtctgtacaaggccctagaggccaggtgtccaggctgcttggggccgtgggtgggctggactctcaggcagacctggcctgagacatcctgggatgacgtgtcctgtcctggtccttactgtgatgtcagtgggtgggggtgtgtgcacagtgcttatgagtctaagtctacctagcactgcagggagggaggcccagcacctcagtggaggtgaaactcaggtggtcttgtggcatgcgtgggtgtccctctgcactctggcctctgtgctcttgggtgctggtgctgtgtcacacgccagggcatgtgaaggcaccacaggtttgcctggggttctaggaggtttgggagccctggaaggcctgagtgtctcctcctgcgtggctgggggagacctcccagaggcttgtaggctaagcacatggctgtagggccttgagcctgcctcgggcctgctgggagcttggcatttccctttcggaggatggaggtgccagggttccagagtcctggggaaggagagagggctagctgcctgccttcgtattagctgggatgcacattgggtgaacaagctgtgactggaggggagggtggtggggagtcctctggcctgaggtggttttgggctctttgtctgcaggtgtgaacgagtccccgatgatgacctggggggaggttgagaacacacccttgagagttgaagggtcggaaacgccctacgtggacaggacacccggcccagcttttaaggtgggttgtggtgatgggggaactgtgtgcgaccggggtggacacctctggagccctgagtgcctgtggctcaggactgagcactgggatcggcccccagctgctgacgggcagagtgctggcttttctgaatgccagggtgctgaaggcaggtgtgggtgggtggacctgtcacagagggatttgggggtgtaagggctgagacaccaaggcagggagtggcttgggccctctggatcctggaggccgggtgctgttcatgaatgaggcaggatggtcacagacacgtgaggagctctgcaggcctgagggccataggacgaggctgtgtgcttgtagagaaggcccctggttacagaacacgattgggacacgctggattacacggctcaagcctggtgttgtaggagtggtcagggtggagtgtgtgaggcccggcacagaccaggggaggctcttcgtgggctgggtcagatacaacaggcctccccataccactgcgggcctttccccagaatacttagtacaggtaacccatgtccagacaaaacatggggagaggttctggttaccttggttctaaattgtctgggacacaaggataaccaaggcaaacgtgcgagagggataatgaagaggatgccgtgctgtccaatgtgagagcgcaaggcaagggctgaggtgcttctgaggtatgcctgccactgcttcccgagtctccaggccaacagtaaacagataaattctgaaacaaaccatgatccaagtcagaatttggggcccgataaagatggcaactcagattgcactgaatagcagagtatttagaaatgaagggagctgggtcctcaggatgtgtagcagcatacattgtggaaaggtgaaaaggttacatgtaaaaacaataaccataaaacaaccagaagaaaatagtggcgaatatttagtttgatttttgggttcaagtgattctcctgcctcaacctcccaagtaactgggactagaaaatagtggcgaatatttagtttgatttttgggttcaagtgattctcctgcctcaacctcccaagtaactgggactacaggcgcgtgccaccacgcccggcttatttttgtatttttagtagagatggggtttcaccatgttggccagactggtctcgaactccttggccagactggtttcgaactcctgacctcgtgatccacccacctcagcctcccaaagtgctgggattacaggcgtgagccactgtgcctcgcctcttttttttttttttttttttttttaacagatagggtttcactctgttgcccaggctggagaacagtggtgcaatcatagctgattgtaacattgagctcctgggctcaaatgaccttccagcctcagcctcctgtgtagctgggactaacagcatacaccaccatgcccagctaattttgtgtgtgtgtgtgtagaaatgaggtcttgtcattttgctcaggctggtctccaatgcctgagctcaagtgatcctcccaccttggcctcccaaagtgctgaggttccaggtgtgagccaccactcccagcctgtagtctaatcttaagttaggagggactttctaaacataaaagcaaaggaagaaatcacaaatgaaaataacaaatacagcagaaaatgttataaatgaaacaaatgtaaatgagtgaaaaaacatgtgcacagcgtagcacagttgacttgacacaaggtcttggcaagggtcttctgagtaacagcagcagaaaaggaaaatgagccccttgagagcaaaataggccacaggcacacggggaagcgcccgaaatacagagcgccgataaagacagagatgttcactctgataatcagggaaacactaaaacagactgctttttcctgagagattgtcagaggtcatggttttgggaggaacacgaagacaggtgaggagtgctgcgccttgggcaggtcaggtggggtttggggctttccaggggcttttagtgggaggtgatgggttgtgggggttttgtaggcaacaaagagaggctggcacccaccacagtggctttctgtgtgaggggctgcctggcgtgtggcaggcctggcgcagctacccacacacctgctaccttgtagatcctggagccaggccgcagggagcggctgggtctgaagatggccaacgaggccgctgccaagaaccgggccaagaagcaggaagccttgcggagagtgacggagaatctggccaggtgaggggccgcctggctggtggggaagtgcgagggtggctctggcctgctcctgttcggcccctgccctgaccgtgtggaggcatggcccacgcggcagagtccagggcaggtccgcggggttctgcagtgggtactgtggcagctcctctatccagagcatggccgcacatggacaggatgagaggccccctccatcttctctttcctccacgtcctctttgacccgtccctaagaggcatctttaggcgtgtggtcctgctgggagctttcatcagccctgtggagagagtcatcgttccccttggagaggggtggggactccaactctcagaggcctgggggtgcaccccagcccccacagccaagggcggtgctgctgtttgacctcaggtttgacctgagcgctgctgtttgacctcagggatcccccgcatttgctgccatgctggcagtaccatcctcctcagctcagagtgactgtgtctctgcccaggctcttcctgggagccaagggaggccctgctgccggcagctctcagcccacctaaccctgcctctctcacccattcctccaccccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagtctggggggttgcctctccatcttgctccccacacgagccctagccttgccctggggcctgcatcacgtctcaggactgcggggcttgaagcgaggggccccccaggtgaggaagctgcaggtggggcggctgtgggagcaccgggtgactggcgttgctttctgcggcactcggaacctgtgttctgagttgagctcacatcctgcagtgctttctgcttctctggggggatatgaaggagaaacggagcccttggaagttgtacccttaggttcccctgcggttctgggcccaggtctgcagcctccactctgggcttgccggctgtgaggtgcgctggttataggactgtgtgggggctgcatatcaggtgatctcagctatcaccttctcccagcacctggcttccagctcatggggtgggactatcccactcacccctctgctataggcactgcccatcttatgctgctggccctggcctcacctggtcacttccaccaacaggagctcccagataacagtgggttgctggacagatcaggctgggactcttaaggggtgggggacgtggggccttcagtgctttatcccctaggaaagggtgcacgttatcccaagggagcccccaggaagtggggagggaggggggaggagcatgtctaggtgctgaccacctggagcacttggccagcaagtgggccgcatgctttgggagcaatgggtgacccagcaggaagcacaaaagaccggccagtgtgccatcatcaagggctgctgagcagcttgaagagccactgggtggggagggcacacggggaggtctcagctggggctgcccctggaggacagggcagggaacttgagggctgaggacagaaatctcacatgactccaggaaatagaggaagaggaggatgctgagcgagggattgtgagggagtgggggtaggtcagagggggctgaactgcaggaagccagggggagtcgtggaccactggagctggccagccccagggcattggggacaaggccaggtcagagggagacagtgtgggcctggtgggtggaccctggcagaggccctcttgtcccccacaaggccaggccacactgtgattctgcctgtacctgagcatctgtcctgtgctcctaggccggagaccactgtgtgtcaggtggggcggttggctgagtcccagagaaaaacactcctcactgggcactcttgatgcttgcacacaccctgtggtttatttggtggtcagtaaggaacgtctttgctgctaagtggaagaaagctaatggaacgtaatcaaaatagtggtttaattgacgaattttacttgcacctgtgccttcttcagatcctacctgcctacttagtttacgtgaaggccgactgcaccatgccccccaaccccgacccccaccacacacaacggggccattgtcatgctaggtgcttgctttccccacctcagctccggagatgtgatggtctttggccctggaggtctcggccagcctgtcctccatcctgttctcgttctcgggcaccaccagcagccggtgctgggttttggctccaagcttgtggtcgggccggtggtcgggcctcaagcctgtcttggtgtccagtttgcactcagcgcggtacttgccctccccctccctcttgaaggaggcagaagacgtggctttgggcttggggggctgcagccacgagtggctgaggatctcatcgatgtggagccgctggctgacgtcgggctgcagcatgcggtagatgaggtccttgcactcgcaggtcaggttcttggagcgcgggaagtccacacggtgctccttctggatacgcagcatcttcctgatgtcggagtcgtcatagggcatggagccgcagaccatgatgtacaggatcacgcccaggctccagatgtcatacaccttgggctggtaggggatgctctgcagcacctcgggggctgcatatgctgccgacccgcagaaggtcttgctgaggatgatgcgcccattgctgtcccgcaggcagcgcttggagaagccaaagtcagacagcttgatgttgaagtccttgtcgaggagaaggttctcgcacttgaggtcccggtggacgatgtccaggtcgtggcagtacttgacggcggaggagagctgtcggaacatcttgcgtgccacgtcctcatgcagggctccctggcacttgatgaactcgaggaggtcgccctggacgccaagctccatgatgatgtagatccgtccgtcagaggtctcaaagatctcgtaagtcttgatgatggagccgtggttgacagttgccaggatgtccatctcccgaggaaggaatctctccacaaagtcagtaggtgttttcttgcggtcgatgatcttgacagccacattgaacttgaggcgctcagagtaggcagatttgacttttgcgtaggaacccttgccaagattgatgcctacgatgtaacccttcttccttaggactgtggcatcgtccatggtgccaggagcgactggcgccgctgccgtctacatccccccgtcatgtgggccagcaggcattgtcctcatttacactaccggaggcgtctggctgggct

SEQ ID NO: 14569 - DNA, 919 bp, Homo sapiens
ggctgagggagaacagggtctctggaaccgtggaagccaggctggtctggcaggagcacccactccccgcccgctggaaggaagcctgtccccaggacaggactctggtggccctgctgctgctgcattggtttccctgtcacaagtcaagctggaggggaggcggcccacgtccagcctgtttgcatcacctggctgtggggactgaccctgcattggtctttgtcccactagggtgggtttcctgcagcttctttggctatgaagaaaagcacccccagggctgtgtccttggtgtggtaggacagttgtccctgacagtcacccagacaggcctgcatagcaccccagttacacagacagatttccacagcactgccttaccattgagcacatagttaaatctagggaaatcagtgcccagacatcaaagctagaaatgaaacatggtcagcaggagccttgcatgggcttctcttttgctggagcaagccaaaataataggaacggttttacattcctagtgccaggacccatctcgggtcgacaaaatctgaagacaagttaagggaacaggcagctgtttgaatagatcaattggatagtctaaggcagctctctggaccaagctgtaaaggagatacaatcgaaataatcactccggtaccacagtagacaggccttgaaggcactgggccccttttaatcggacttagcaagcattttttttgcctctgaccttctccttggaacaaaattagttaccagtagacttaggtgattgctgtactgcatgtaggcacataaccccaacctatataaacagtaagaaaattgtagcactttgagttggtctgctggaattatctccagccttctccctgtatccagttacagtgataaactcccttctttccta

SEQ ID NO: 14570 - DNA, 845 bp, Homo sapiens
gggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaaggtattgatgacattttctgattacagaggagactctcaggactgaggaattgtcacccatgcttggccaatctcccaaactgtcatgcctctggcaaaagcaaagatcacctctcaccttctaaagactggccccagtacttctctaacaatcccttccctcaccgacacccacccaccaataaaaaacaaccacccaactctctccctgcttccccacaagtcctgtgaagagccaggctttctgtgctcatggcttgtcttctttgtgctgtagagcctccctctaatcttgtccatgcagtaaagagagatcacacaaaccctggacctacctctttgaggtggtactctcaaactctttgaaggtctgtatttgatggaatctctgggaaactgagttgggaaggtccctatatgaaaaacacgtgggttcttggagtgtacatctttaattttcttatttgtctctttagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgacaaa

SEQ ID NO: 14571 - DNA, 173 bp, Homo sapiens
caagattatcaactgtgtgtttgacagtgaatattaaatatgttaccagttgaaatttttggttataaatgtaatacgaattgtttcacaaacaaaacatgtaaagcagtattaaaatttggccaaacaagtgttctgtatctactttaataaatggttattctttaaaaaaa

SEQ ID NO: 14572 - DNA, 3794 bp, Homo sapiens
  misc_feature (1606)..(1607): n equals a,t,g, or c
  misc_feature (1619)..(1619): n equals a,t,g, or c
  misc_feature (1624)..(1624): n equals a,t,g, or c
  misc_feature (1644)..(1644): n equals a,t,g, or c
  misc_feature (1678)..(1679): n equals a,t,g, or c
gcaaaggccttgcaaggatcttaaccgaaagggggagggggaaggtcgccaacaaacggctgagctcacaatccgggccggggcgtcccccaacctccatggagagagctaggctggagccgccgcctcagccgcaccctttgagtcccgctccgtccctgctgccggtcgagggcacctccttttgggcagcggccgtgaagacccctccgtcgccgcccatgctgtgcgcggccgccattgcgaccgtggcctcctcgtgtagggagggtttggtgccgtgtgcggcgcagcagctgctggaggtgaagctggagcaggtgttgctgctaccacagccccacgttcctggcaagggcgccgcttcctctcccagcggcagttcaggcccgacctgcggctcctgctgccgcccgcctcttccgagggcgccccctgtaggcccgagttacacccggtgcagccccgggcgctgcacgtcaaggccaagaagtaggagctaggggcttgcctggacgcatcggtgaggcctcggggggccgtggagaccggtcgtagagcctccagggcggtcaagttggaaggcctcgggccggccctcgactacttccgagggaacgagaagggcaagctggaggcggaagaggtcatgagggacgcgatgcagggcggggaaggcaaaagctcggcggccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggtattagacagcaggggagtcgggttttcaaaactgcgtctgtgttgcccatagctgttttgtcagcagttcccaagtctaaactacaaaagtaaagtaatggaactgattgttttcagggcagagtctgcacaggtatcacttctgatcgacttgtacatatagcagtaaaatacacgaatgccttcaagattctcaagtattttttaaaaaatcgattttaaggcccagtatttagataggactaatttttgtacacaaaaatagaaatattcttgctagacagcgcatagccctcagtttatatgctacaaataatcaagattaaaaatattgtagtataacagctcagtacttttatatgtatcaagaaatagaagaaataatggtgttgaatgaaaaaagtgattataattaaacaggaaagtttataccgattatagaggctatctttaaaaatgaataataaatattctagcagaaaacaatacgtgattcaatgtaatattttagggtttattcctctgaaaggtaatgacttatagaaatattgaaaagaatanncaggtagggaantgganggcgcactaaaagtagttantttttagagatggaaatgagctaagttagcagcnnagtcaagcaagtaccacaataatgtattttattgtgctagttcagtattcgcagatatatagtcagcaaattcttattttaagatttagttcacacagaacgcttgccgagtgaacatcttggaaagtcatattaatctttggttcatatttttattaactttatgttttattgtttttttaattttctgtgttgattcttcctctccactccaccctgttgcttttatctttagtagtttttagattttatttttgttttctaaaggaaagaaagggaaagctttctttatactacttatttcatctttagtgtttttaagaaatttttaatatatgaagtaatcctaaaataatataataaatttatggacagttatttttgataaaatacatgagagatgtgaatttagataacttcctttgttgaaatttcaactggctctgtgactttctttttttaaattttattttatgaaaaagagatgctggtctcgaactcctgggatgaagcagtcctccgccttggcctcccaaagtactgaggttacaggtgtgagccattgtggctgccttctctgactttcaaaaaaattacttttattattttctgtcattttttttctgaaatattggcagagaggttctaggaatgaaggtcagaagcaagtgtgagccattttacctgccttctgtgactttcaaaaaattatttttttgagactgagtctcactctgttgcccagtctggacctggacaacaggaatgaaattctgtctcaaaaaagaaaagaaggtggcagcagctcaaccctgggcaccctgctctgcttgaaagaatgagtgtgtttctggagtccatcttgttcacttgtctcttcctagcgcccaacacagtacctgtcccaagcaggccctaaggacaggtttaatgaatccatcaatcagggtctatgggaacagtggggtgacagcactcaggatttcgagtaagcaggtgaaactctacctgtccatagcaaaaagtgggagaagagcctcagctctcatctggaaaatggggataatccccaaaggaaaaaattgacaagatggtgttgaggcccattcaaactctaggacccaagactttggttttctgtttttttgtttgtttgttttttgagatggagtcttgctctgttgccacacacctggctgccaccacacctggctaatttttgtatttttagtagagacaggatttcaccgtgttagccaggatggtctcgaatctcctgacctcaagtgatcctcctgcctcagcctctcaaagtgctgggattacaggcgtgagccaccgcgcctggcctaaaaaattatttttattgttttctttcatttttctcccaggacacaggactagtgttgatgattccacttggtaagagcttcaccttcgtagtgaaatacaactaatatagtattacaatattataaatagttttgcttgaaaggacacaagagcagcatgtagatgagttcctgtgaatgtttagagaacctctacctagctaagattatagtcacgagtaagtcatgcatggttcctgttccttaatggtagaatatttttagtagtaaataaataaatgttaattattgttagaggtactaataatacagatcaaagaagtaataagccaacaatttactctcttcaacatgattattgccacagttatcttcaacaatattatcctctttgaggaaaaggagtcattctaaactacagttcagaatgatgagttcaggggatgtaaggaattgtggaatactggcaggtttttttggttatattgaagtgtatatttcctccagatatttcaaaaataagtatagacggaggtgcactttaccttaaaattgtgtgtgtgtgtgtgtatggcacattaatttagccttttaatttttgtcatgtaggcataccagatactcccttcagtaaggacagaaatggtcatgtgaagcgacccatgaacgcatttatggctttgggcaaggatccaccgaccagacatctagccagagctaacccagcagccaacaatgcagaaatcagtgtccagcttgggtt

SEQ ID NO: 14573 - DNA, 397 bp, Homo sapiens
gccaggtataagaactcctgttgaccacatttgataccacaggattagacaatgaattggagttggtcttctttgagtgataacttgtcttgactgcaaaaatcatctatgtcaagataaactatagcttttggccagaatgtcatttagaaatgcagcaaatgttaatacaggatttctttttgtttttcttggtgatgtttaatggaaataaacacaatcctactaaaaggagaagcataaacatggaaaggatttggaacagtgtctagcgtaagagtaagcccttaacacaggtagtgattattactgttttattattaccctatcacagtcgctattcatttatttattcaacaagtatttattgagtactatatgccaggctcaatggtct

SEQ ID NO: 14574 - DNA, 2639 bp, Homo sapiens
cagcaggcagcgctctctgccctctgctacatccggagtcagctggagaacccaggtaatggagggagggccaggcagctgagccgcagctggggacaagaggactgaggctggcagtcccgtggggaggcggaagtggctgtgcgtgtgagcaggaggtgggttgctgtacaaaccatctgagcatcaggacgtcacctgcagggagctggggcggggtacatgtgccggtccctgctttcacgtcctctggggacaccgggggtagggaccgctagaagagcagctcgtgtaatgtcctgtgtctggaagatgaaaacttcctctccccgcctccttggcttcctgagggacggagggtgggccttggcacccacaccagcccgccctccttgcctctttcagagtccccccagacctccagccggcctccactggcccccctgagcgtaggtaggtgagcattcccggacccaggcttgtagtgtcgaggggagaggcgtgggcccccttctacctgcagtctctcgccctggcgcagagaacatcctgacccatgagcagcgctgcgcagcgttggtgagcgccggctttgacctcctgttggacgagcgctcgccatactgggcctgtaaggggactgtggctggagtcatcctggagaggggtagggatcgccccagccctggccctggccccggccccctgggaagggccccctcaagctccttgccttaggctgggccgtctctgccccctcctgcacagagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggtgaggggcagtggggtgggcgcctgatagcagccttcgccaggacaaggtcttcccaaccaccctgtgcctgtcgctcctaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctagtatgcagggcccccggggcaggcgggggatggggctccctcggttgggctgctgggtgggggccagggtcagaagagcagccctgaagctgatgtctgtccccacccggcccgcagcctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagtgacaagctggcacgctgggccgtgctggggctgggtggtgccctgctggcccacctggtgtccccactctacagcaccagcctcatcctgggtgagcacgtggtgagggctgggggggtgagaagggagggcagggaggtcactcaccttgtcctgtcccttctgccctgcagctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaagtgagaagggccccctggggccgggctgtggagcagtgctggtgatggagggctcatgcatgagcttcctcacctcagtctaatcccagcgcaaccccttcgctcaaccccttcgctcaaccccttcctagctccgtagtggtggccacacctctgtctgccctgtgagtcctgtgacattgtcacagtgtgagaggaggtagtgtgaggtgtgtagcaggcctgctggtccagcttgtatctctctgatctcagtggtatcctctcttcatccagtgccgccctggggcctccctcccgtctctgcaaggcctcctttctccgggcctttcaccaggcggccagggctgtggggaagccctacctcctggccttgaagacctacgaggctgccaaggttggttccccaccctccccccgtcccggtccctctccagccctgcagtccctgccccctgcaggtacctcctctcaccccacctctcatctcccgccctaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtt

SEQ ID NO: 14575 - DNA, 3288 bp, Homo sapiens
ggtacgtgcagcactacggcctgggcagtgcctgtgacaacgtagagcgcgtgctgaagagtgtggctgtgaagctggggaagacgcagaaggtgaaggtgctcacgggcacgggtgagtgaggtcgctgatgcgggcaccggagcctcaccccatcaccctgggggaccccggccatccctggaggaggcagggaggagaggaacgtgtcaaggagcatgcgccgggtcttctgggaatgggtttcagggcaggggagctacagaaagttctggagaggaagggcttgtagtccaggcttccgagggtgagaccagccctgccgcgtattgggcagtgctaggtggacacctgcaggcctcacatgcctggccttggaggctccgggcagcgtagctcaagctgttttctttctgagtgtgatcccgttccctgggcttccctgatgccatcatggagcctcttagggctggtccctcaggtgggtaagggctgggcctgtcctgctgtgaaggctccttcctcactgaaccctcccgtcccccaggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtgaaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcacgggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggcggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcc

SEQ ID NO: 14576 - DNA, 868 bp, Homo sapiens
tattttgagtttcaccttgttaggtgatggatatctacattcctgtaaaaattcttgagctttgttgtgggacagttagattattggaaacagtccggtcctttcaggagttcttcccattggcaggtctcgggggtggtccggggcgcctcctccaggcttgctcctctctcctgggacagcttttttggagcaccagggcacccttgaggctgctgattcagagctcatgcttggtgcctccgagaagttagatttagaacctgtgttactcagggttctgatgctcctatgggctctgagctcatgtcttgctttgctgggccttggggtgagtcctctgttaccggctcatgctgtgaccaggtccgagggcaccagcctcctcaaggttgagcctgccctcgtgggagccacgagacaggttcccctcacccctggctgtcaggaaggttgggagagtgttgggtctgggttagtcgggctcccaaggcttagggtggtgtttgtccctgtgagtggctgctctgtgctggcctttccctccaggcctctctgcccagagcctgcactgtgaggagtcagagtgcccgttacaatcactgggtgacgcttagcagcggtgggtgcctagtcagcccatgctggtccctgtgctaggaaaacaccgctcaaacacccagccgggtggagaggatgcaggtgtactggctgcctggaagttaccgagtgccatccttagcagcaaacagagtatgtttgcagatggtctgctgtgctcctcttttagtttccaggacctgggcctgcacagaggcctgcctgtcctaccccggatagagtggatgaagcctgtgtgtgtgaacag

SEQ ID NO: 14577 - DNA, 19842 bp, Homo sapiens
  misc_feature (2039)..(2039): n equals a,t,g, or c
  misc_feature (2064)..(2065): n equals a,t,g, or c
  misc_feature (2067)..(2068): n equals a,t,g, or c
  misc_feature (2070)..(2070): n equals a,t,g, or c
  misc_feature (2085)..(2085): n equals a,t,g, or c
agcctgtgtgtggccctgcccccagggctggctgtttctgtgcttaaagccatcttccaggaagtgcatgtacaggtgagggataacagtcatgttggtattctcctctgtctctaccccttgacataactgggattcaatagcaaaaattattgccttctaagttctgaattcttttggatcttgtgaatgtttttatgctcttcttcagtatgtttatatgctcatctttgttattggacaaggaaaggggtgcatgccattagatctgacctgtgtcctcttatacctacagaaagtaaggcatccctctgtcaggcaggtttgaattattggcaccactgctgtgctgctgagtcaatatccataccctttctctgtagtttctcttagattgatcttatgctggtataaagagcactgttcacttagagattatgaagcaggaactagctgtgtcagctgaggtattctttgagcattttcttcacttctttctcccccacccccaagtccctgccacaggtggaccgacacacagtctacaatatcatcaccaattttatgcgaacccgggaagaaggtaagagacagagctttctgggaaatgtcaaaagcaagcacatcctactttttcccctattagtaggactcattttacctggggttatatagaagagctggtatcctgagagagaatgataaagggaaagagggggtctgctccctcccagtgaagtaaagaaagggtagagtttgtttgagccagtgttttaaattcttgcctccacagcaatgtgtatattgttgcacatctcttcactgagtactttcttggaatggaaaaagggtcagccctgaagagaaaggggaggcaatgatagcagagggagaacacaggctaggagaaagcccacactttctgtgctgtgggacagtatagtaaccttattctctccttcccagagctaaagagcctaggagctgacttcacctttggcttcatccaggtgatggatggggaaaaggatccccgtaatcttctggtggccttccgcatcgtccatgacctcatctccagggactatagcctgggtatatcgtggtagccatgattagctcattggagctttatcagatgagtgaagctgataaaccaacctcattttttctctgttgccacaggaccctttgtggaggagttgtttgaagtgacatcctgttatttccctatcgattttacccctgtaagtagcaccttcattgtttgatcatatatttattgagtgtctgctatgtgccaagccctgttctgggcactgagggtacaggtcaccaaaatagacatccccgccctcattattttatattttaataaactaggaaatggaaaagcatttgacatatgaggaatgattcaaagcagcatgtattggggggaattcttaagctccttaacactgtatttagtgctgaaggctacaggattgcaaaacactgtccctgcccttgaaggctgaaacatttaagtaacaataggagattaggtaggaaaatgagtagtactatagctgttcagagaagacaaaagttcagtgtgagctagagtaggcaggaactgacttcacagttaagataggatttcagctggtttgtgagggatgcagaagatatgattctggagttggacagggcatctcaggctatagaaacaaagtgacaaaacaaagaaggcacaattgtgcacagtgtacagaaggtatttgctctgaccctcttgggccttcctcccattctgcagttgagttcccttctactgccaaatactcaagagtttcatcaccgtgtgggtgtgtgtgctgcaagcattagtggtttgaaagaaataaaaggcattctattgcagcatgccaaacagcatattgactctcactgcctttataatgacaccaccatctttgctgtagggaatttcttaccagcttatttcagttgacattatgttactggggaccacctgtctcctgaaatgaatctanaaaaaaaaaaaattttctcttttcnnanncnaaccttattcttgtnaggtcttgaaagatcctggtttagctcccacattcttctgtttttactttggtttttttggtgtgtgtgtttcttttttgtttgttttggtttggtttttgcttttttgagatggagtctcgctctgtctcccaggctggagtgcagtggtgtgatctcgactcactgcaacctccgcctcctgggttcaagcaattctcctgcctcagcctcccaagtagctgggattacaggtgcccaccaccatgcccggctaatttttgtatttttagtagaaatggggtttcaccatcttgaccaggctgatattgaacccctgacttcgtgatccaactgcctcggcctcccaaagtgctgggattacaggcgtgggccaccatgcccagcctttactttgttttattttgtgttttgtgttggttttgaaaagataattcattcacatgattcaaagtccaaaagggtgagaaatctccctaccatctttttttctccataatcaaccaagttatcagttatgtttgtatctttacagagctttttcatctatatgtaagcaaatgcttttaccaccacccccctaaaatcaatgtgtgcacatgcgggcatgtacacacacacacacacacacttctcctgtactttgcttttttcactgaacactatgtcttggagagtgttccacgtcagtatataagttagctctttcattctttatggctgcataatattcctttggccggaaataatgaataatttcactagtcctctgtggattgttgctaatcttttgctgttatgagcagtgctacaactttcatacatatgaatataatgatagaataaattcctaaaagaaatcgctaggtcaaagaatatgtgcatttataatttgggggagaggaacagtatttcatccatttttttgaaaggttatacaatgagcatgattcagcatttaaagggtagataattaaacttctttcatacccctttactgctactgtccattttcccattagaaacaatcactgttcacagctgtttattttcacagagataatctaggcaaaataaacttacagataatattaggaagatttctctcattcaagcagatttttgtatgttgttctgcactgcagtctatcagaagcagaaagctcttatcaagatattaattaaaacagagacacttggctttagtgtaactatttgagttacaaatactctttattgtcttacaaatcagggtttttattgttgttggttctgttctgttttgttttgtttttcagacagggtctcactctgttgcccaggctggagtgcagtaacacaatccttgctcactgcaacccctgcctccggggttcgagtgattgttgtgcctcagccacctgaatagctgggattacagtacgtgccaccatgcctgactaattttttttttatattttttagtagagatggggttttgccatgttgtccaggttggtctcgaactcctcacctcaactgatctacctgcctcggcctcccaaagtgctgggattacacgtgtgagccacatatccagccacaaatcagtattgtgtgccatcatagtggatctgatgagcttaaggttcagtttcttcactatgcttatatgctcactctaagaagaggttggcaaactttttctttcccttttttttttttttttttgaggcaggctggagtgtagtggcaccatcacagctcactgcagcctccacctctctggactctggtactctggtgatcctcccacccctgcctcccgagtagctggaaccataggcacatgacactactcccgactaattgttgtatttttctatagagacaggattttgccatgttgcccaggctggtcttgaattcctgggctcaagccatccacctgcctcgacttcccaaagtgttgggattacaggcataagccaccatgcctggccaactttttctataaaaggccagacagtagctttgtgggtcatatggtctcctcaactctgctgttactgcacaaaaacagccttagacacaggaacagctacagtagctatatcccaatagaacttttgttatcaacactaaactttgaatttcatataattttcacttgtcacaagatattcttttggtttgtttcaaacattaaaaatgttaaaaccattcttagccaaacaatgtcaacaggttgatttttactcctaatgcagagtagatattggttcttccttcaccgtcatcctagattcccttatcctttttcttggatcagatctcctgtttcctgagttcacatattcctcattttgtggtttaccccctcagtttgatggtgtacttcctttagtattttcctgagagaatgtatgaagaagtgagaattttttagatttgtaacccttaaatgccttcaatcttgtctctcatttttgacattatgggcatgtaattcaagaatagaaattctaggccgggcgcagtggctcacacctgtaatctaagcactttaagaggccgaggcgggtggatcacttgaggtcaggagttcgagactagcctgaccaacatggtggaatcccgtctctactagaaatacaaaaattagctaggcgtggtagcaggcgcctgtaatctcagctacttgggaggctgaggcaggagaattgcttgaacctgggaggcggaggttacagtgagccgagatcacgccattgcactccagcttaggcaacaagagtaaaactccatctcaaaaaaaaaaataaataaaaagagaattctagctggatgcagttgcacatgtctgcagtcccagctacttgtgaggctgaggcagaacaatcacttgaggccaggagtttgaggctgtagtgcactatgattgcacctgagaaagaggccaggtgcagtaactgacgcttgtaatcccgctactttgggaggctgaggcaggtggattgcttgagctcaggagttcaagaccagcccgggcaccatggcaaaaccttgtctataagaaatacaaaaattaactgggcgtggtggtcgagtctgtagcccctgctactcgggaggtggaggtgggaggatggcttgggctggggaggcagaggttgcattgagccaagatcatgcctctgcactccagcctggaagacagagccagactcagtcaccaaaaaaccaaaaacaaaaacaaaaaaaaaatggaaattattttctcctaagattttgaaggcattgctacatttaaatctagttattggctgggcgtggtggctcatgcctgtaatctcaacacttcgaaaggccaaggcaggcggatcacctgaggtcaggagttcaagaccagcctggctaacatggtgaaaccccatttctactaaaaatacaaaaaaattagccgggcatggtggcgtgagcctgtaatcccagccactcgggagacaggcaggagaatcgcttgaatcctggaggcagaggctgcagtgagccaagatcgtgccattgcactccagcttgtgtaacaagagcaaaactccatctcaaataaataaataagcctagttatctagttttcatttgctgtggagaagtctgaatttcttctgtttcataaacttttgtatttaccatttttttcttcctctctataaactgatgtttggttcaccccgatacattgaaacttcacagtgatgtgccttagtattggtctatttcatgtactgtgttgggtacttagtaggccctgtcaatctggtaacccgtgtccattagtcctgtaaatttttcttgaattctttaattgatgatttcttcctctctcttttctctgttccttcattttggaactctcattaatcttctgttggacctctgattttctgaccttttgttttctattttgtacctctgtctttttgttactttataagagaattccacagttttatcttttctatcaaagtccagtcatgaaaacagaaaccaggccaggttcggtggcttacgcctgtaatcccagcacttcgggaggctgaggtgggtggatcattcgaggtcaggagttccagaccagcctggccaacatgatgaaaccccatgtctacaaaaaatatataaaaattagccaggtgtgttggtgcgcctgtaaccccagctacttgggaggttgagacatgagaatcacttgaacctaggaggtggaggttgcactgagctaggatcaagccactgcaatccagcatgggtgacagagtgagactctgtctcaaaaaaaaataataataataatagtaaatcccttcttttactatgtttttggtggagtttgcaaagaggaaaaggaaaacctgatatatgttttcagtctgtcgtcttggtacagaaaccatcaaggctttctgttttcagaattacagctttttataagggtgaaaaaaatggaaatgtccatcaacaaggaattatctagataaactggtacaaccacaaaatgaaatcatagccactaaaactaatgctatgaaagaataataccataaaaatgttcttaatatgttaagtgaaaaaaattaaaaaccacatgtacaaaatgatttttaagtatatatatattttatatggaaacagtatatactagcacatagtaacaatatatatcagcgaagaaaggaatacaccagaaagttaagcatgcttatttctgagtggtgaaatgatagaaaatgtgtaatcagattttttaaaatgcctaaagacaaaagttcccaaggagtacctaagatcaagcaagtcttcttgctggggcctcattatcttactatcttccctgattgggtatgagtatcaccctgttctgcagggttaccaggttcgagcctgtgttcaaggtggtctgaaatgttacacaaacccacagcccttctcccttttccagccacctaatgatccccatggtatccagagagaagacctcatcctgagtcttcgcgctgtgctggcttctacaccacgatttgctgaggtgggtctagccaaggttagggtatatagcctctgcccatagatggctctgaagaaagagcagtaaaagcatggagaaaaaaatatctggtatacattttagggcatgacaccctgcaagtgtcttgtgtggcaggtatcttcagaccttcgatgtagaaaactttaccatctcttcataatccagagctggattcagtggcacacacctatagttccagctactcaggaggagtctgagtggaaaggatcacttaaacccaggagttcaaatccagcctgggcaacatagggagacctcgtctccgctacacaaaaaaataaataaacccaatccctatatggtgctgtcttttaaaatcctgtaactttgtcaacttgcctgtttttgaggtagtggggctctggtcactgcttggcaggaaggttagcttacattcatagctcctgacttgagtacagctccttgatgtagtacctgcttttagggactgatggcaaggacagggttgaccttgatgtgactgacacaccacccatctcaggcttaagatcttccttctgtcccacagtttctgctgcccctgttgattgagaaagtggattctgaggttctgagtgccaagttggattctctacagactctggtgagtgatttttctccttgcaggacccagctaccttttgacaagttaggggtcctaaaggatatagattctaggatagccaaggaacagttcatgggcctcagaagaggatacccaggatttgggcctttgtgtcgacctgaagcccccagctgcatatcgtcgtgtcccatcccccatcccatagtaactgaggaaaggctgaccaggactccctctttaggcttctattttatcaaccagggttatctcctacttctctgttcccttagtaggactgttaaaaatcttaactggtttttctgctgagaccagggctccttcaggtgccattatgctgaggtacctgcacatcctagggtgtctgagtgtgtacataactgatagcagcggtttccttggcagaatgcttgctgtgctgtgtatggacagaaggaactgaaggacttcctccccagcctttgggcttctatccgcagagaggtgagtgtcactcagataaactcactactgttaactttcaattgtcaggcatgaggggaaataatacatcctgtccttttccctctgtcatccccagggccaagatataatgcctggttattcaggaggcaagtagggggacataattctagttgaatgacaagagagagagtccctatgtgacggtcagctgcttggtaagagcagctgatcacctttgcacattacccacttcttgtccttctgtggcaaggagtgcaggtcatggtgcctttggcaccatggtgaatagaaaggtgagcagagccactgctcagagttggctttttgtttctcagaaagtatgtgtctctgtcctgagtgtgactaaggacttggtaagaacacaccaattgagaagacactcagttggggtgttaatttccatttctgtgtcctagaggttctcactcccctctccaacaaggaaataggcagtggattggtggggtctcatctggtgcaggctcacctcagtagccatgggatccctccctgacaggtgttccagacggcaagtgagcgggtggaggcagagggcctggcggccctccactccctgactgcgtgtttgtctcgctctgtgctgagggctgatgctgaggacctccttgactccttccttagcaacattctacagggtaatggggccgtggcagccaggaaggggagtgagcacaatagaaacgacattccttgcctgggtgcggtggctcacgcctgtaatccctgcactttaggaggccgaggcgggtggatcacctgaggtcaggagttaaagaccagcctggccaacatggtgaaacctcgtctctactaaaaatacaaaaattagccgggcgtggtggtggacgcctgtaatcccagctactcgggaggctgaggcaggagaatcgcttgaaaaggcagaggttgcggtgagctgagattgcgccactgcactccagcttgggcaacgagagcaaaactccatctctaaaaaaaaaacaaatgacattccttaagggccagtgacctttattgtttagtcccaacatatttggtgatttgggggcgatagccctactttgaattgaaaacaatttgagtgttaactgcttgcaaactgtcatgggtctcagtctccaacctctgtggactgtaggggagtcaggcaccatttggcctcctccccagctctgtgatgtgctgcttctctagactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcaggtaagggagcagaatctttgggggaaatgatgggacctgtgtgctaggttccctttctcagagagtgagctaagttttagcttgggccaacatagtagaccttgggttttgctcccattaactgctgctgctgcttcccttactcactttttccctgtctcatacataaaaggatcattctcccaagacaggaggatagcttgaagccaggagttcaagatcagcctgggcaacaaagtgagatcccatctctaaaaaaaaaaaaattttttttaaattagccaagcaggacatgctggttcatgcctgtaatcccagcactttaggagaccaaggcaggacaatcacttgaggctaggatttaaagaccagcttgggcaacaagacaagaccacatctctacaaaaaaaaaaaaaaaaaattagctggataaggtggcacgcatctgtagtcccagctactcaagaggctgaggcgagagaatcacttgaacctaggaggtcggggctgcagggagctataatcatgctactgtattccagcctggctgtggcatagcaaaacccccatctcttggaagaaagaaagaattttccctatatccagagtagcaggattgaaatcctttaaaatattctttgactctagtaccccttgaaacgttacagagcagccagcggcggacaatccttgaaatgctcctgggtttcttgaagctgcagcagaaatggagctatgaagacaaaggtgaggttgccttccattgcagtgctctggggactgttgaacacttcagcctataaaggatagcagggcaaagagtgctgtggaaaagtagtctagaacagtggtcctattctgaggttgtagcacaagagaacacttaacagatgagatggatgagatctgtttatttttctcagtgtgctttctggatacccaatggattaagctctttaaatctgccccaggaggcggggcatggtggctcacacctataatcccagcactttggtaggctaaggcaggcggaaaacttgaggttaggagttcgagaccagcctggccaatatggtgaaaccctgtctctactaaaaatacaaaaattagccaggcctgttggcacatgcctgtaattccagctactcgggaggctgaggcaggagaatggcttgaacctgggaggcagaggctgcagtgatccgagattacgccactgcactccagcctgggcaacagaggccttgtctcaaaaaaaaaatctaccccaggttggctgtgtatcacagcttagtcagggatatggaatgcagtggcttccttctaacctggcctctgtctcttccctagatcaaaggcctctgaatggcttcaaggaccagctgtgctcactggtattcatggctctaacagaccccagcacccagcttcagcttgttggcatccgtacactgacagtcttgggtgcccagccaggtacatcttaagggaaagagaagaggaaaatattggtccttttcttgtaagactgccttggtgaaaagcagccttactatcctcttcttactgcaactctggatgatttgggatttctaataagagcttagaagggttgtgatggctgcaggggaagaaagatgagattcatgttcccttctaactacagatctcctatcttatgaggacttggagctggcagtgggtcacctgtacagactgagcttcctgaaggaggattcccagagttggtgagaatttaaagcaatgagatagagcaagctgttccctgcctctgtattggcagcaaaagatcaagctaggaccagggctctgtgcttctgacccttggctctccttaggggaggtgagctctgtgttagactctggctgctaaccagttggagagatgtaggactgctctcttcttaggctttaagaagccctgtccaactcagtggtgtaggtacttgagttctgctctttagcaaggaggcgttgggagctcacactcctgaatctgcctaatatcagacgtaggcaagagagctgtgagcccaggctcagccaatgcttatctgctctgcgcctccagcagggtggcagcactggaagcatcaggaaccctggctgctctctaccctgtggccttcagcagccacctcgtacccaagctcgctgaggagctgcgtgtaggtatgtgtctctaatcctctgtggcccatccctttccagcaaggctttggggccttcgtgcttcctatcacacagtaaacctttgtctcatgggttgctttcaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagaggtaactactaggaataaccaccaacggactgggctgaatagggagctgtagtctctaaggcagtggttctagctgtagctatacataagagtaacagaatcaactcttttaaaagaaaaaaaaaatactgatgcctgcgtccaactgaatcagtctctgaggagggatgggacttaggcaacagtactattaagagtacccggccagggccgctgctcttgcctgtaatctcagcactttgggaggccgaggccagcagatcacttgaggtcaggaatttgagaccaacttagccaacatggagaaacccagtctctactaaaaatacaaaaaattagctgggcatggtggcatgcgcctgtaatcccagctactggggaggctgaggcaggagaatctcttgaacccacaaggcggaggttgcagcgagctgagattgcgccactgtactccagcctggccagcctgggcaatagagtgaaactctatctcaaaagaaaaaaagggttgggcgcagtggcacatgcctataatcccagcactttgggaggctgaggcgggtggatcacaaggtcaggagtttgagaccagcctgaccaacatggtgcaatcccgtctctactaaaaattatctggtcatggtggcaggcgcctgtaatcccagctactcaggaggctgaggcaggataatcgtttgaacctgggaggcggaggttgcagtgagccaagatcatgccattgcactcacacctgggcaaacagggtgaaactccatctcaaaaaagaaaaaaaaaagtgccgggctgggtgtggtggctcatgcctgtaatcccagcactttgggaggccaaggctgatggatcacttgagctcaagagtttgagacctaaccagccgatgcaacatggcgaaaccgcatctctacaaaaaatacaaaaattagccaggagcagtggcatgcacctgtagtcccagctacttgggaggctaaggcaggagaatcactttgagcccgggaggcagaggttggagcaagccgagatcgctccattgcactccagcctgacctgggcaacaggagtgaagccctgtctccaaaaaaaaaaaaaaaaattacctaggtaattttcatgtgggatctgaattgagaggcatcaccctaaggccgtggtgctcaaaagatggtctgttaaccagcagcatgggtgacatctgggagcttgttagaagtgcagaatctcaggccctcactgatcagaatctgcattttgacagtgtaccctggtaactcgtagactgttgagtttgagaagcactgctccaatgcaaaagtgacagcagcctgccctgtgggtagattcaggcccactgtggttgatccagcagctgttacatagtagaatgaatactagacttggattataacttgggcttgattcctgactttgcacttcctgtgaccctggaaaagccactgatcatgtatttcattgtgcctccatgtccttctctatagagtgagggaaatgatacttctaaggttgttatgaaaaataaggagagaatatatacaagtgcttctgctgcagagcctgggacagagcaagtctcaactatgaagtctgaatagatcagaaagaacagccaggagaataaagtgactcagctttttaataaggcactcttggtcccttcagtcactcttctttgttcctctcatctgctgtgtaattggaaacacctgaaagtgcttttaagcaaaccttacagagaacactttctcatcaacagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccaggtaactttccacctctccttcctggcctttgggaactttgccctctgctggtgttgaacagcaccaccctctgggtattggtggtactgtattttgtaccatcagaggtttattttcaatcctttgtcctcagagtgagatttcacttcatagcaaagggtgccaccctgaccagtggcaggaaccaaaatccactagtgttagcaacattcaaaagaatgcacaccttttccccatgaagtgctatgtgattagtttacttagaattggactctggagtcaagcccacctggttgggttttatcctcaactctaccacttgctaacttaggtgaagatattcagcctttccacgcttcaatttcctcacttgtaagatggagataaagagtaccgtctaggctggcgccatggttcacacctgtaatcccagcacttcaggaggccaagatgggaggatcacttgagtccaggagtttgagaccagcctgggcaacacaggggaccctgtttctacaaatagtcagacatagtggtgcacacctatagtcccagctgctcaagaggctgaggtgggaggatcacctgagcccaggagttcaaggctgcagtgaggcatgattgtgcctctgcactcgagcctgggtgacagagcgagatcctgttcctgtctcaaaaaaaaaaaaaaaaaaaactgtttcacagggtagttggtaaggattaaataagttagtgtatagtacctgccacataggaagtactcagtgtatgatagttgctataaataataaggacccatgaagataaatctatgtttttaattttttcagagaccaacattactatttttttttccttgcatctccagggacaccagggacaacatttctatttcttatgttaagaatgttcatcttagctatccctctttcccactgttggcctagtctaaagactgtgcagagttctcaggagcgctctgtggccccaggtcagaccactcctgtttctggtgccctgattctcaggactatagcactaccagagaccagattaagaactgctgtcgtggctagagtcaagccccagagtcagtgatgctgacagaacccaatcattcatttcttgaacccgtcatggtcttgtgattgtgtgcatgtgtgtgtgttttgcagagaaggagccctcagttctgagaaaagtactattggaggatgaggtgttggctgccatggtgtctgtcattggcactgctacaacccacctgagccctgagtaagtataatcatggatgtggcttgaacccagggagaaggatagcattcttaggaagaagcaacaggtagctgccttgtcagctgtccttttacctatatgtaaatgtggtgcagttaatcgtcttgtaagttttgttgacaaaacaaaaggaaggggctcttagcaccatggactatgagggtgggaagccagggccagtggttcttagccgcagatgtgcttaagaattacctgtagagcattttaaaatataccttgacttcccagatgggaacctgaatggaaatgattactggcacatatgtgccaaattaatatttgttcaatgcatgaatgatcagggcatgtcccattgacgtggtgatcctaattcaaaccctaggttgaaaagcacgtctgtggaggagagggctgctttagaatcctagctccttggtcatacctagtactctgcccccaggttagctgcccagagtgtgacacacattgtgcccctcttcttggatggcaacgtgtcctttctgcctgaaaacagcttcccgagcagattccagccattccaggtaacagtcttagaacttacatccttcaagctggtttttttttagggctaatctggaatgggtagaggggcagacaagcttattgctggcaggcttgatcgggctctccttcctttataggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtgttctctgggtccattacatggccaggttttctgtaggtggaaatccctcagctgaaccaactcatgcgggagcttttggaactgagctgctgccacagctgccccttttcttccaccgctgctgccaagtgctttgcaggactcctcaacaagcaccctgcaggtactgagatcagactatgtaaggagcctcccagaatcaactacccatgaaatcttatagctcagtactcattctctttttaaaaggagcttgctaataacattaacagggcttcaactgctcaagcactgtcctgggactgcccgtgggaaaagcgtcaagaccacagttgggcagagctttatagtacctaagaagagaagggagcacaaagagtctagttctgccgtcctactccctacagtggggctagtgtggataattctttattggaagtagatgaccctctcttttcaaatggcagcacctctgtattatgagaataccaggctcttatgcaggtgtccaatcattttgtccacaggcaaaaatgatattttccctttctaacagcttctcagggagctctgcacttaaagtgatttgcatttcattgctaaagggaaaatgtgtagcctttatgtcagcatttcctctctcctttttagggcagcagctggatgaattcctacagctagctgtggacaaagtggaggctggcctgggctctgggccctgtcgtagtcaggccttcactcttcttctctgggtaaggagttggagtggagtctggttagccagagaggcaattatgtctggttaaataaaatgtccctgtttgaccctaaaccataaacatctatgtctcagggttctcgggtttgagtgtcattccccaattgctctctctgtctccaattacaggtaacaaaggccctagtgctcagataccatcctctcagctcctgccttacagcccgggtacgtcctttctggagacagaagaacccaggacctaaacaaactttctggttgctcctattcctcccaaggacttccatcctcccctgtgtgttttttgttttcttttcttttttctttttggagacagggtcttactctgtcacccaggctggagtacagtagtgcaatcacagctcactccagcctcaacctccgtaggctcaagtgatcctcccacttcagcctcgcaagtagctgggactacaggggcaccccaccacacccaactaatgtttgtattttttgtaagaactgggtttggccatgttgcccagactcctagactcaagcagtccacctgccttggcctcccaaagtgctaggattacaggcatgagccaccacacccggccccatccttatctttggcacttaagattcttcttccctgatgtacctcaaaggctcttttttctccagctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaaggtgaggagtctgaaagaaggtccccacatatacacatctctcctttgcttggccacattccctaagataatttagggcccgcttgcttctttagagctatattgtggtctgtgcctagaagactaaacttctagattcttgtcccacttcttcctttcatgggcgtatcttgcttattctgagcgtgaagggctctttcacccgtttgtaggctgatgtctcagcctcaccacagattggaattgatttctcaagctatatatctaagtccaatttctcccctaagcctttccattttttacagatgtgaagccaaactacttgaagggtctttctcatgtacttaacaggctgcccaagcctgtactcttgccagagctgcccacggtaagtcccacaggcagagcttctaagcaaaggacaaagctattcttccccagatggggctagaaaggggagggaacaagaaccaggatcttcatgatgtggccatcccctaccttgcccattgccccttagcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggtgcgttgagccccagcaactcttaggcaccagcatctctccctgggcatgctctcacctccttgtggttgtgttccaggctgtccggatcgccgcactgcagtgcatgcatgctctcactcgcctgcccacccctgtggtaagtacctcaggtgtccttccctggcctgggaacatctcaagagacacataagtacctttttgccttagtcaggtgggcttggccaccctggtgtgtaattgagatctgaattacaaggtacagatcttgtaattctgggcccaaggattcttttccttgggcccagaaggtaacagaaaggccatcctgccacttaacatcccttggaatcactaaagatgttttgctttcctcagaatattagttgtacagaatcaaaaaagcggtactttcagttgccttggatgagcaaggttgattatatcctctgactccacagctgctgccgtacaaaccacaggtgattcgggccttagccaaacccctggatgacaagaagagactggtgcgcaaggaagcagtgtcagccagaggggagtggtgagtttctaggtcgtggggagagatgggaccaagatgagcctcatcactaatgctgccaactttctttttgcccacaggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataaccagaggcatcactggaataacaatgacagggattggccaaaaatttttcagggtaaccaggacagtagcacatgcctgtaaccccaacacttcaggaggctgaggcaggcggatcacttgaggctaggagtttgagactagccctggcagtatagcaagaacccatctctacaaataattaaaaaaaaaaaa

SEQ ID NO: 14578 - DNA, 346 bp, Homo sapiens
gctacttgggaggctgagacacaagaatcacttgagccgggcgcggtggctcacgcctgtaaagcttgtaatcccagcactttgggaggccgaggcggatggatcacaaggtcatgacatcgagacctcctggctaacacagtgaaaccccgtctctactaaaaatacaaaaattagccgggtgtggtggcgggcgcctgtagtcccagctactcgggaggctgaggcaggagaatggcgtgaacccgggaggcggagcttgcagtgagccgagatcacaccactgcactccagcctgggtgatatagagcgagactccgtctcaaaaaaaaaaaaaaaaaaaaat

SEQ ID NO: 14579 - DNA, 330 bp, Homo sapiens
cctaaaataatttctttcttttttttttttcttaactgttcaaggtttattgggggttttagttggtataacacttggatagttggttgcattgtttatatgtagatgtttttacattatatggtaatgtacactactgatatagttcacaaaataagatcctttggaagaattatgcacaagacatatgatattagatttatacactggatcccaggatgtgactgattgggaaaaaatgttggactaggcatgttcagtgaaggagccaggaagttatataacacacagtaaacatccacctggctcaaggggcaaatgcagcacgta

SEQ ID NO: 14580 - DNA, 3536 bp, Homo sapiens
gtggaaatccctcagctgaaccaactcatgcgggagcttttggaactgagctgctgccacagctgccccttttcttccaccgctgctgccaagtgctttgcaggactcctcaacaagcaccctgcaggtactgagatcagactatgtaaggagcctcccagaatcaactacccatgaaatcttatagctcagtactcattctctttttaaaaggagcttgctaataacattaacagggcttcaactgctcaagcactgtcctgggactgcccgtgggaaaagcgtcaagaccacagttgggcagagctttatagtacctaagaagagaagggagcacaaagagtctagttctgccgtcctactccctacagtggggctagtgtggataattctttattggaagtagatgaccctctcttttcaaatggcagcacctctgtattatgagaataccaggctcttatgcaggtgtccaatcattttgtccacaggcaaaaatgatattttccctttctaacagcttctcagggagctctgcacttaaagtgatttgcatttcattgctaaagggaaaatgtgtagcctttatgtcagcatttcctctctcctttttagggcagcagctggatgaattcctacagctagctgtggacaaagtggaggctggcctgggctctgggccctgtcgtagtcaggccttcactcttcttctctgggtaaggagttggagtggagtctggttagccagagaggcaattatgtctggttaaataaaatgtccctgtttgaccctaaaccataaacatctatgtctcagggttctcgggtttgagtgtcattccccaattgctctctctgtctccaattacaggtaacaaaggccctagtgctcagataccatcctctcagctcctgccttacagcccgggtacgtcctttctggagacagaagaacccaggacctaaacaaactttctggttgctcctattcctcccaaggacttccatcctcccctgtgtgttttttgttttcttttcttttttctttttggagacagggtcttactctgtcacccaggctggagtacagtagtgcaatcacagctcactccagcctcaacctccgtaggctcaagtgatcctcccacttcagcctcgcaagtagctgggactacaggggcaccccaccacacccaactaatgtttgtattttttgtaagaactgggtttggccatgttgcccagactcctagactcaagcagtccacctgccttggcctcccaaagtgctaggattacaggcatgagccaccacacccggccccatccttatctttggcacttaagattcttcttccctgatgtacctcaaaggctcttttttctccagctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaaggtgaggagtctgaaagaaggtccccacatatacacatctctcctttgcttggccacattccctaagataatttagggcccgcttgcttctttagagctatattgtggtctgtgcctagaagactaaacttctagattcttgtcccacttcttcctttcatgggcgtatcttgcttattctgagcgtgaagggctctttcacccgtttgtaggctgatgtctcagcctcaccacagattggaattgatttctcaagctatatatctaagtccaatttctcccctaagcctttccattttttacagatgtgaagccaaactacttgaagggtctttctcatgtacttaacaggctgcccaagcctgtactcttgccagagctgcccacggtaagtcccacaggcagagcttctaagcaaaggacaaagctttcttccccagatggggctagaaaggggagggaacaagaaccaggatcttcatgatgtggccatcccctaccttgcccattgccccttagcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggtgcgttgagccccagcaactcttaggcaccagcatctctccctgggcatgctctcacctccttgtggttgtgttccaggctgtccggatcgccgcactgcagtgcatgcatgctctcactcgcctgcccacccctgtggtaagtacctcaggtgtccttccctggcctgggaacatctcaagagacacataagtacctttttgccttagtcaggtgggcttggccaccctggtgtgtaattgagatctgaattacaaggtacagatcttggaattctgggcccaaggattctttttcttgggcccagaaggtaacagaaaggccatcctgccacttaacatcccttggaatcactaaagatgttttgctttcctcagaatattagttgtacagaatcaaaaaagcggtactttcagttgccttggatgagcaaggttgattatatcctctgactccacagctgctgccgtacaaaccacaggtgattcgggccttagccaaacccctggatgacaagaagagactggtgcgcaaggaagcagtgtcagccagaggggagtggtgagtttctaggtcgtggggagagatgggaccaagatgagcctcatcactaatgctgccaactttctttttgcctacaggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataaccagaggcatcactggaataacaatgacagggattggccaaaaatttttcagggtaaccaggacagtagcacatgcctgtaaccccaacacttcaggaggctgaggcaggcggatcacttgaggctaggagtttgagactagccctggcagtatagcaagaacccatctctacaaataattaaaaaaaaaaaa

SEQ ID NO: 14581 - DNA, 19842 bp, Homo sapiens; identical to SEQ ID NO: 14577
  misc_feature (2039)..(2039): n equals a,t,g, or c
  misc_feature (2064)..(2065): n equals a,t,g, or c
  misc_feature (2067)..(2068): n equals a,t,g, or c
  misc_feature (2070)..(2070): n equals a,t,g, or c
  misc_feature (2085)..(2085): n equals a,t,g, or c

SEQ ID NO: 14582 - DNA, 345 bp, Homo sapiens
gctacttgggaggctgagacacaagaatcacttgagccgggcgcggtggctcacgcctgtaaagcttgtaatcccagcactttgggaggccgaggcggatggatcacaaggtcatgacatcgagacctcctggctaacacagtgaaaccccgtctctactaaaaatacaaaaaattagccgggcatggtggcgggcgcctgtagttccagctacttgggaggctgaggcaggagaatggcgtgaacccgggaggcggagcttgcagtgagccgagatcgcgccaccgcactctggcctgggcgaaagagcgagattctgtctcaaaaaaaaaaaaaaaaaagaaa

SEQ ID NO: 14583 - DNA, 346 bp, Homo sapiens; identical to SEQ ID NO: 14578

SEQ ID NO: 14584 - DNA, 330 bp, Homo sapiens; identical to SEQ ID NO: 14579

SEQ ID NO: 14585 - DNA, 989 bp, Homo sapiens
aaaaattataatcttagccgggtgctgtggcttacatctgtaatcccaccactttgggagaacaaggcaggaggatcccttgagcccaggagtttgagaccaccctggtcaacacagaaaggcctcgtctctatttattattattttttaaataaaaaaataaagaattataatcttgatgtggttaattgcacctttgtgtctattacctgtttctgttgcaggtgaacttaatagagcattaggtctgtcatcactctgtggagaaacagacatatatcaataattgttattcaagaagaaatactttctacttttatggtaattttgaaattataaaagacaaaaaacaggtaactctccttcacgattaagtctagaggtgagaatttgggtcaggtgcagtggctcatgcctgtaatcccagtactttgggaggctgaggtgcgaggattacttgagagcaggagttgagaccagcctaggcaacatagtgagaccctgtctctacaaaacgtctaaaaaattggtcaggcattgtggtgtgctcctgtagaggctgaggagggagggttgcttgagcctaggaattaaagactgcagtgagtaatgattgtgccactgcactccagcctgggtgacagagggagactctctctctccctctctctctctttttttgagacaaggtctcactcttgttgcccaggctagattgcaatgccatgatctcccaggctcaggtgatccttctacctcagcctcccaagtagttgagactacagggacacatcaccatgcccagttaatttttgcattttttgtagagacagtgtcttgccatgttagccaggttagtctcaacctcctgagctcaagcgatgcacccgcctcagcctcccaaagtgctggattataggcatgagttaccgtgcctggcctgaccccctttggaaaaaaaaaaaaaaaaagaagaagaagaaaaagaa

SEQ ID NO: 14586 - DNA, 165 bp, Homo sapiens
ttttgtttttttgttttttgtttttttttttttgagatggagtttagctcttattgcccaggctggagtgcaatggcacgatctcagctcaccacaacctccgcctcccgggttcaagcaattctcctgcctcagcctcccaagtagctgggattacaggcatgc

SEQ ID NO: 14587 - DNA, 7540 bp, Homo sapiens
ggcggggcgtggaccagccgcgccgagcggggcctctccgggccgcgtctgtggggtcgagactgcgcggccgttgggcgtgcagcggcgccagtcggcggacgaggggcccccgggaggtaggtgcgggcagagagaggacctggggcggcggggcggggcggcgctgagcggccgggggtctgttggactctacccgcacgttagccgaggcccgtctccggtgcccggtagcgcgaggcacacagaaggcgctcaataagtgctgattgaatgaatgagcccgtgccctcctcatcccggcccgagcagcctccggtttgagagcgtgcaggccaccctcaccttcactgtacagactgaggtatccagatgccggacaggtctttattgggcgcctactgtgtgcctgggtggctctgcgctgggtgcagctggccctgagcaagacagacagcctggtcccgcccagctcaccgccgggggggagggacgactttaaatgacttaaaataatgtaattcctagctccctctgtagcacaaaataaaagaaaataacaccagggaagggggcggggagagctctgagtggagacatctgagcagtgacccgaagacctgaatgcagtgaggtagcggggccatgaggcgcttggggctgatggtgggggagaaaacccagttggggaaaactcaaggacaggggaggagctgagattcctcctaagaacggtgacattttggggtccagggtgaaaccgacttcactttggcccattgcatcaggtaaaatgcggcccttatcagtggccacacgcttcccctcgtccatgtgttcagccagcggtttttgagtatctgttctgcagcaggccttccggcgggtacagggatatggtttagggcaggagtcagccaggggcagagagggaggccctttttttttttttttttttttttttgagacggagtcttgctctgcagcccaggctggagtacaatggcgcgatctcggctcactgcaagctccacctcctgggttgaagcaattctcctgcctcagcctcccgagtaactgggattacaggcacgtaccaccatgcccagctaattttttttttttttgagacagagtcttactctgtcacccaggctggagtgcaatggcttgatcttggctcactgcaacctccacctcctgggttcaagtgattctcctgcctcagcctcccaagtagctgggattacaggtgcccactaccacacccagctaatttttgtatttttagtagagacagtgtttcactgtgttggccaggctggtcttgaactctcgacctcaggtgctggtctcgaactctcgacctcaggtgatctgcccacctcagcctcccaaagtgctgagattacaggtgtgagccaccactcccaaccgagggaggcccttttgaggggtcctggatgcagagaagcaagaaagaagaaggaggcctcgctggaaggtcaggggaaagagagcagtgttccaggtggagagaggagaacccatgcagaggtcctgaggcacgagcaagcttggcacagaaaggaccagtgagggccgaggcgaggcaggagcttgtcatgcagagcttcagcctcagggtacagagtttagactttatttcggggcatggggaagccatggaccaccaccatccaatagcatgttctgcagtgatgagagtgttccctttgctgtcaaatacggtaaccacagaagtcaagtaggcttgtgtgactactgagcgcttgaaatatggccagggagactgaggagcggaattttgtattttatttagtttttttttttttttttttttgagatggagttttgctcttgttgcccagcctggagtgcggtggtgccatcttggctcactgcaacctctgcctcctgggttcaagcgattctcttgcctcagcctccagagtagctgggattacaggtgcctgccaccacggccggctaatttttgtatttttggtagagacggcgtttcaccatgttgtccaggctggtctcgaattcctgacctcaggtgatccacccacctcggcctcccaaagttctgggattgcaggtgtgagccactacacccagcctggattttttttaattttgatgaacttttttctttttttgagacagtgtattagtcagggttctctagagggacagaactaatggaatagttatatatataaagggaagtttattaagtattaattgcacacgattacagggtctcacaatacattgtctgcagattgaggagcaaagagagccagtccgagttccaaaactgaagaactggccaggtgcagtggctcacgcctataatcctagcactttgggaggccgaggcaggcggatcacgaggtcaggagttcgagaccagcctggccaacatgatgaaacctcgtctctactacaaatacaaaaaaaattagctgggagtggtggcgcgtgtctgtaatcccagctactaggcaggagaattgcttgaatccaggaagcggaggttgcagtgagcggagattgcaccattgcactccagcctggcaacagagcgagactctgtctaaaaaaaaaaaaagaaaaaagaaagaaagctaatgcagtgcccctgatgttcacagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggtaagggctccctgggcactagcagcagcccttggcaccttatggccaagggactctgatgcattttcaacactgatgccaagttcagtgaaggccttgatgctgtaagggtgacggaaagtaggaagtgaatttgctgtgtgattgtgaactggttactttctgtctctgtgctctaccggccaaacaaggggtttggaccagacctgggattcccaacaggtggacttgtcggttgtcacctgataatcagaccagactacccacctaggtagggcacactctgtcctgaagctggaaagcatggcctctcttcggttcctatatcagtcagctactgttgcgtaacaaattatagcaaactgagcaccttaggactacagacgtttatcatctcacagtttctgtgagtcaggggtctgggcactgcttcaggagctcacaaggcagcagtcacagtgtctcctgggctgtggtctcatctcaacgttcaaccggggatgggtcggcctctaagctcatgtggttgtaagccaggttcagttcctcattggttgtcagaccgaaggtgtctgtttgtcagtgtctgttggctggggcagccctcagagcctggccacgtggacctccccagcatgatcagttccttcatcagcaaatggagaagatggccatgactctgtgtaagacagagggcacagtcccatgtcatgcagaggtgacagggtatcccttcccctctgccccagtgtcctgctggttagaagcaagttcaagtccttcccatactcaagtggccaggacctcacagggtatggctgtcaagaggcaggggcttctggggccatcttggagtctgtccaccccaactcctgacagcatcatcctctgctgacctgttccttgagctcccccatatcagcagcccagagtgtgggtcccctgtcaggccacagtgtgaccagccctggccatgcttgctgggtgaccctgggtgagtggcttcctctctctgggccagtgccagatgtgacattgaatttgtgttggttacatacttggtggagatatgaggaccccctgttcttcctcccaacgaaagcatggaagccctaagcttatcccccaacccctggccctgcttttcctcgtgcctagtgtccagaaaggaggagaagggctgttgtctgggattaaatcatctgagcctgttagtgtggcagagtagagttccagggtggctccctgagcttccagcccctgctccgcacgccccatgctcttccctcccctcgagtgtgggtagggctgggactgccgtgcgtgtcactcctgccattatgtcagaatcccagcagaggggatgttgcagctgtgatgaccgccccagatcggttagcgctgagttcatcaaaagggagggggtgggcctggcctaatcaggtgagccactcaccctcctgctggccttggagaagcaaaaagccagggtgtgccaggagaagggcatgaagcgaggacccgagggcagcctctcggtgccaagagccatccccgccaacagccagccaggacacggggcctcagtccacagccaccaggaggtggactcttccgacctccagtgagcttggaagaggaccctgggtgtcagtgagatctcagccctgatgacaccctgcgagacctggagcgtagggcccagctagcccgcacctggatttccaccgttcagagccgagacaccgcattcctgctgttccgcgtggctgagtctgcattcgttcgttacgcggtgtgtgaagactgacatctgcactgcgaggatggagatcttggtcatctctgacatctcctgcatcgcagaggccactgccagccccccttttcccccatggtcatggtgtcacccccgtcaccctctgactgcaggcctgggcgactgcggggagcttgctcttccctccccctcatcacagtggccttctcatggcacccaaacctttcccgccgttctcctgtcctcgggctggtcaggcggatgaggtccctactcccgagcccccagcctcacccactgcagggccaggctctcagtcacccctggaaaatggtgcctggttcacagctcccgtgcatctgcctcatctctcctgatcaacgtctgtctcttgggagtagctagagttcctcatgagcttgtcctcaagcgaggcatgcatgaggcctccagccggtggtcagtgagggagttaagtggcttctccgtggaaacacagccttctgctgcagcagaggctcacccagcgtgaactgcccccagggaacactgggcgatgcctggggacattgtggttgtcacgatggggggtgctcctggcctggagtgggtggaggccagagacactgctcagcagcaccctgcagtgcccaggacggccccgtcccagagaacaatccagccccgaatgtcagcaccttccccctacccgagttgtgaaaataaaaaatgtttccagacattgccaggtgtccacacgggcagaatcgccctggttgagaaccactgtgtgcgcgtgcttgtgtgtgcacctgcgtgtgcgcgtgtgtgtgcgtgcgtgtgtgcacatatgcgtgtgtgtgtgtgtgtgtgcacgtgcgcaggttgtaatgaagtctccgctgggaaggaagcagggaagcaggcattgttgagtgtcgattgtgttgtgattttcctccactttggtctcgaggtctctctggagggtggctgtgaactctggccctgccgtgacgaggctccagggagctgttgtgggcgtttacagcctgcctttcatgagacatttcatcctggcgcatagcctaatgcctgcgtgtccgccccgtgagcagctgtccctcccataggagtgtgtacctcttgcagacgccctgcggctcccgtctgacccacgtctagtttctccccaccaaagtctcccctcgctaggagagccctgaccaggaggagagtcgggcccaggcatgtcggtcagggaagcagagaggaggccccgcggcagaacacgcaaggccagtgcagctctttatgtgtttattttgagccggagtctccctctgtcgcccaggctggagtgcagtggcacgatctcgtctcactgcaacctctgcctcctgggttcaagccattctcctgcctcagcctcctgagtagctgggattacaggtgctcgccaccatgcccagctaatttttgtatttttagtagaaacatgtttccccatattggccaggctggtctcgaactcctgggctcaagcaatccgccagcctcagtctcccaaaatgctggggtcacaggcatgagccaccgcgcttggctggtggtggtggtgttaattcatcacaggcgagcccttcctctcccacttgttttaacctctgtgtgaatcggggatttctggactttgctttgaacggtgacatctggccagccctgtcgccgccacccctgagcgtgggtctctctctctctctcgggtgtccccggctgcagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttaccaaa

SEQ ID NO: 14588 - DNA, 181 bp, Homo sapiens; identical to SEQ ID NO: 7550

SEQ ID NO: 14589 - DNA, 129 bp, Homo sapiens
caagctactcaggaggctgaggcaggagaatggcatgaacccgggaggtggagcttgcagtgagctgagatcgcgccactgcactccagcctgggtgacacagtgagactccgtctcaaaaaaaagaga

SEQ ID NO: 14590 - DNA, 170 bp, Homo sapiens; identical to SEQ ID NO: 7565

SEQ ID NO: 14591 - DNA, 109 bp, Homo sapiens; identical to SEQ ID NO: 7566

SEQ ID NO: 14592 - DNA, 184 bp, Homo sapiens; identical to SEQ ID NO: 7572

SEQ ID NO: 14593 - DNA, 147 bp, Homo sapiens; identical to SEQ ID NO: 6794

SEQ ID NO: 14594 - DNA, 169 bp, Homo sapiens; identical to SEQ ID NO: 7578

SEQ ID NO: 14595 - DNA, 131 bp, Homo sapiens; identical to SEQ ID NO: 6213

SEQ ID NO: 14596 - DNA, 143 bp, Homo sapiens; identical to SEQ ID NO: 7597

SEQ ID NO: 14597 - DNA, 170 bp, Homo sapiens; identical to SEQ ID NO: 7598

SEQ ID NO: 14598 - DNA, 171 bp, Homo sapiens; identical to SEQ ID NO: 7603

SEQ ID NO: 14599 - DNA, 141 bp, Homo sapiens; identical to SEQ ID NO: 7393

SEQ ID NO: 14600 - DNA, 125 bp, Homo sapiens; identical to SEQ ID NO: 7605

SEQ ID NO: 14601 - DNA, 175 bp, Homo sapiens; identical to SEQ ID NO: 7613

SEQ ID NO: 14602 - DNA, 154 bp, Homo sapiens; identical to SEQ ID NO: 7620

SEQ ID NO: 14603 - DNA, 176 bp, Homo sapiens; identical to SEQ ID NO: 7624

SEQ ID NO: 14604 - DNA, 150 bp, Homo sapiens; identical to SEQ ID NO: 7633
  misc_feature (21)..(21): n equals a,t,g, or c

SEQ ID NO: 14605 - DNA, 162 bp, Homo sapiens; identical to SEQ ID NO: 6214

SEQ ID NO: 14606 - DNA, 129 bp, Homo sapiens; identical to SEQ ID NO: 7645

SEQ ID NO: 14607 - DNA, 193 bp, Homo sapiens; identical to SEQ ID NO: 7396

SEQ ID NO: 14608 - DNA, 177 bp, Homo sapiens; identical to SEQ ID NO: 7651

SEQ ID NO: 14609 - DNA, 140 bp, Homo sapiens; identical to SEQ ID NO: 6216

SEQ ID NO: 14610 - DNA, 2922 bp, Homo sapiens
ggtggcgctaatcccagttactcgggaggctgaggcaggagaatcgcttgaacccgggaggcggaggttgcagtgagccaagatcgcaccactgcactccagcctgggcgacagagcaagattctgtctcaaaaaaaaaaaaaaaaaagatgaaaccaagtatacaagcccagaagcccagggctaatgggactggagtgtaaaaggaagaattactataaaatggtgctaggggccaggcacggtggctcacgcctgtaatcccagcactttgggaggccgaggcgggcggatcacgaggtcaggagatcaagaccatcctggctaacacggtgaaatcacgtctctactaaaaacacaaaaaattagctgggcgtggtggcaggtgactgtagtcccagctactcgggaggctgaggcaggagaatggtgtgaacccgggaagcagagcttgcagtgagccgagattgcaccactgcactccagcctgggcgacagagcgagactccgtctcaaaaaaaaaaaagaaaaaaaaaggtgctaggtactgtgactgtgaaatcgatatcattattggatttacagctggggaaaagctttaaagcttatacaacttggcaaatgaaggtcacacagctagaaatggtagagcccaggtctaactccaaagttctgtgctagttaccttacaaactttgtctataatcttccacaatcccaaaaagtgtattattacattttgcagttgagaaggttgaggctgggggtgttaagtaaaacacacaaggttacacagctatgaagtatccaagccaagattgtatcccaggtctgtgggactccgaagcaagtgctacattctgctgctgggcaatgcggggattactgtgtgccttgagctccctaagagttctcaacaccacttcttcctttttgacaggctctggctgggctttgaccttcgctccgaccctggcctgcctgtcctgttatttctctcgccgacgatccctggccaccgggctggcactgacaggcgtgggcctctcctccttcacatttgccccctttttccagtggctgctcagccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcaggctcccacagccctggtggctctggctgtggcctacggcttcacatcaggggctctggccccactggccttctccgtgctgcctgaactaatagggactagaaggatttactgtggcctgggactgttgcagatgatagagagcatcggggggctgctggggcctcctctctcaggtaagtggaatggggttcccagggggtgagggctgccatgttgcacaactaggggagggtactattctcattacagtgtatgtgaatattgccctctggtgtagtacagtacacagcctgcgtggccaaccatagcatccctgaaatgggtccatggggcaaagaacttggggctgggaaagtctgagtggaaagacaaaaagaagctaagtggaacccttggcagggtgcctacggcttgggtttgcagaggacctggcagaacctggccagacacagacgtagcattccagtgtgcaccctttcctttggcctactgggccccaaaccaggtatctgaggcacctggtcaaagttctgctggctcagggtgccagaactttcagacctttatctcctcttacccattaactgaagctttagaaaggccacagttggtgggcgcctgtagtcccagctactcaggaggctgaggcaggagaatggcatgaacccgggaggcggagcttgcagtgagctgagatcgcgccactgcacttcagcctgggcgacagagcgagactccgtctcaaaaaaaaaaaaaaaagaaaggccacagttgccagaaagaaaggcacaagtatgcctgactcaatctggatctccaaatccctgcaggctggtttggaggtcctttctgaaggcggggaggtggttgaaattaacttttgaggcccttttgggaaaccagagttcttaagtttatccaactattccatgggagttccaactcctctgagatgataagtcttccctccacccaaaaatgtatctgagccctcagccccagcaaatagatcactcatgtgtattctttttctctcttggacctaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaaccctttgtattttgttgagga

SEQ ID NO: 14611 - DNA, 39 bp, Homo sapiens; identical to SEQ ID NO: 8912

SEQ ID NO: 14612 - DNA, 153 bp, Homo sapiens; identical to SEQ ID NO: 6795

SEQ ID NO: 14613 - DNA, 121 bp, Homo sapiens; identical to SEQ ID NO: 7669

SEQ ID NO: 14614 - DNA, 2910 bp, Homo sapiens
ctcgggaggctgaggcaggagaatcgcttgaacccgggaggcggaggttgcagtgagccaagatcgcaccactgcactccagcctgggcgacagagcaagattctgtctcaaaaaaaaaaaaaaaaaaaaaaaaaaagatgaaaccaagtatacaagcccagaagcccagggctaatgggactggagtgcaaaaggaagaattactataaaatggtgctaggggccaggcacggtggctcacgcctgtaatcccagcactttgggaggccgaggcgggcggatcacgaggtcaggagatcaagaccatcctggctaacacggtgaaatcacgtctctactaaaaacacaaaaaattagctgggcgtggtggcaggtgactgtagtcccagctactcgggaggctgaggcaggagaatggtgtgaacccgggaagcagagcttgcagtgagccgagattgcaccactgcactccagcctgggcgacagagcgagactccgtctcaaaaaaaaaaagaaaaaaaaaggtgctaggtactgtgactgtgaaatcgatatcattattggatttacagctggggaaaagctttaaagcttatacaacttggcaaatgaaggtcacacagctagaaatggtagagcccaggtctaactccaaagttctgtgctagttaccttacaaactttgtctctaatcttccacaatcccaaaaagtgtattattacattttgcagttgagaaggttgaggctgggggtgttaagtaaaacacacaaggttacacagctatgaagtatccaagccaagattgtatcccaggtctgtgggactccgaagcaagtgctacattctgctgctgggcaatgcggggattactgtgtgccttgagctccctaagagttctcaacaccacttcttcctttttgacaggctctggctgggctttgaccttcgctccgaccctggcctgcctgtcctgttatttctctcgccgacgatccctggccaccgggctggcactgacaggcgtgggcctctcctccttcacatttgccccctttttccagtggctgctcagccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcaggctcccacagccctggtggctctggctgtggcctacggcttcacatcaggggctctggccccactggccttctccgtgctgcctgaactaatagggactagaaggatttactgtggcctgggactgttgcagatgatagagagcatcggggggctgctggggcctcctctctcaggtaagtggaatggggttcccagggggtgagggctgccatgttgcacaactaggggagggtactattctcattacagtgtatgtgaatattgccctctggtgtagtacagtacacagcctgcgtggccaaccatagcatccctgaaatgggtccatggggcaaagaacttggggctgggaaagtctgagtggaaagacaaaaagaagctaagtggaacccttggcagggtgcctacggcttgggtttgcagaggacctggcagaacctggccagacacagacgtagcattccagtgtgcaccctttcctttggcctactgggccccaaaccaggtatctgaggcacctggtcaaagttctgctggctcagggtgccagaactttcagacctttatctcctcttacccattaactgaagctttagaaaggccacagttggtgggcgcctgtagtcccagctactcaggaggctgaggcaggagaatggcatgaacccgggaggcggagcttgcagtgagctgagatcgcgccactgcacttcagcctgggcgacagagcgagactccgtctcaaaaaaaaaaaaaaaagaaaggccacagttgccagaaagaaaggcacaagtatgcctgactcaatctggatctccaaatccctgcaggctggtttggaggtcctttctgaaggcggggaggtggttgaaattaacttttgaggcccttttgggaaaccagagttcttaagtttatccaactattccatgggagttccaactcctctgagatgataagtcttccctccacccaaaaatgtatctgagccctcagccccagcaaatagatcactcatgtgtattctttttctctcttggacctaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaaccctttgtattttgttgagga

SEQ ID NO: 14615 - DNA, 158 bp, Homo sapiens; identical to SEQ ID NO: 7682

SEQ ID NO: 14616 - DNA, 193 bp, Homo sapiens; identical to SEQ ID NO: 7690

SEQ ID NO: 14617 - DNA, 183 bp, Homo sapiens; identical to SEQ ID NO: 7707

SEQ ID NO: 14618 - DNA, 136 bp, Homo sapiens; identical to SEQ ID NO: 6219

SEQ ID NO: 14619 - DNA, 153 bp, Homo sapiens; identical to SEQ ID NO: 7724

SEQ ID NO: 14620 - DNA, 150 bp, Homo sapiens; identical to SEQ ID NO: 7399

SEQ ID NO: 14621 - DNA, 142 bp, Homo sapiens; identical to SEQ ID NO: 7400

SEQ ID NO: 14622 - DNA, 181 bp, Homo sapiens; identical to SEQ ID NO: 7737

SEQ ID NO: 14623 - DNA, 123 bp, Homo sapiens; identical to SEQ ID NO: 6220

SEQ ID NO: 14624 - DNA, 176 bp, Homo sapiens; identical to SEQ ID NO: 7741

SEQ ID NO: 14625 - DNA, 177 bp, Homo sapiens; identical to SEQ ID NO: 7751

SEQ ID NO: 14626 - DNA, 154 bp, Homo sapiens; identical to SEQ ID NO: 7755

SEQ ID NO: 14627 - DNA, 166 bp, Homo sapiens; identical to SEQ ID NO: 7759

SEQ ID NO: 14628 - DNA, 142 bp, Homo sapiens; identical to SEQ ID NO: 7402

SEQ ID NO: 14629 - DNA, 131 bp, Homo sapiens; identical to SEQ ID NO: 7764

SEQ ID NO: 14630 - DNA, 268 bp, Homo sapiens; identical to SEQ ID NO: 7767

SEQ ID NO: 14631 - DNA, 906 bp, Homo sapiens; identical to SEQ ID NO: 7771

SEQ ID NO: 14632 - DNA, 2705 bp, Homo sapiens; identical to SEQ ID NO: 7772

SEQ ID NO: 14633 - DNA, 368 bp, Homo sapiens; identical to SEQ ID NO: 6222

SEQ ID NO: 14634 - DNA, 2925 bp, Homo sapiens; identical to SEQ ID NO: 6223

SEQ ID NO: 14635 - DNA, 87 bp, Homo sapiens
ctcacgcctgtaatcccagcactttgggaagccgaggcgggtggatcacgaggtcaggagtttgagaccagcctggccaacatggtg

SEQ ID NO: 14636 - DNA, 127 bp, Homo sapiens
agacggagtcttgctctgttgcccaggctggagtgcagtgatgtgatctcggctcactgcaacctccgcttcccgggttcaagcgattctcctgcctcagcctcccaagtagctgggattacaggcg

SEQ ID NO: 14637 - DNA, 212 bp, Homo sapiens; identical to SEQ ID NO: 8934

SEQ ID NO: 14638 - DNA, 127 bp, Homo sapiens; identical to SEQ ID NO: 14636

SEQ ID NO: 14639 - DNA, 87 bp, Homo sapiens; identical to SEQ ID NO: 14635

SEQ ID NO: 14640 - DNA, 1548 bp, Homo sapiens; identical to SEQ ID NO: 7779

SEQ ID NO: 14641 - DNA, 4704 bp, Homo sapiens; identical to SEQ ID NO: 7404

SEQ ID NO: 14642 - DNA, 125 bp, Homo sapiens; identical to SEQ ID NO: 7783

SEQ ID NO: 14643 - DNA, 7203 bp, Homo sapiens
aagcaggggagaaagtgcgttttttatttatagggccatctgcaaaaggggcaaactgtctgtcaccacccgctccaccaactttacgggcgggggtgggggtagggagtcattcctcccgccaacccccgcaatcctcagtaacctataatctggggaaaagggtcccgagggctgggtcatcccgtgcctcccactgggtttaggacgcgacagcggaatgggcaggaggtggaggtgcacttctgcaaatctcaagaaccgaagccctggaggcggcggatgagaaagtccacagccctagcaattttgggtgtgtaggcagggatttagcgtatgtccacagccgctctagtgagggtgcccccacccacgttcctcggaagggcagcgctccatccccaccctgctaccctttccccgagagcctaatcccaccttagctggcgctcccggagcctccggggcaggagggaggcgtggcctcgggcggcccgcccctttgatgtgcgccggcaccgctgcgattggacagtcgcttgtgacgttggggactgcggtgggctccgctgctgcagcagccgcagcgccggccgcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgtgagtcctgggctccgggagataggggagggctggggtcccggcgcggggtgggggctgtggagtttgaaggcgctccttcacgcgcgtggcactgggggagttctggagctcaggagtgagtccccttctctctcctacccaggaacatagtgctggggtatccctccgtccccgactctgacaaagccaaggaattggtgtccccttgctccctgccacccacaatacccctccccgagccgcgcaccccccgcccgcattggagcccagcgcccgccagccgggggtgcgccagagtgctggcttcctagtcacctctaaaaatatctctcccccaaccctaccggcagctgccacctccctgcccctgcccctgcccctaggatcccctcccagcttgtcctcccacccagggagtgcccagaggtgactgctagacccagacgcctcactggcaccagggcgcagggccaccaccgccagctggtcaggaccgcaagctccctgcccactggagtctccagggccaaggggggagctccagctgcaattctcccaagaggcgccagagactcctgagttctaatcgcggttccgatgctgtgtgacccctaggatgttagcctgacctctctgggcctctgtttttcctatctgctgctcgggcgtggtgagcaaggaagatggtcatgtttgggagcactgtctgggaaagggagggaattctagcttagttgttggatctgatttctagtgattgatacaaggagacttgtttttggacagagagggcttgttactgtggtctttctggagtcctcgcctccccatcctcattctgcacatttcctttggaaaactatcccaaaacttttctaggaactccatctgcccagtaagaggggaatttgaaacttagggcctgtatcagagaggggcctgtttccctcccacccccttcccacagatttaatctaagagcatttgtgtgaaaggcgggagaagcaggcagggatctgtgacccggtgcagaattaaggaggcaggcactgcttttaggtgggactagaatatggactccctgcaaccccccagaagcccttctccctgctctggcctgtgagagaagctcagatcctgccccctactctgagggactctgtttggtgaccacaaaaggatttgatgactcagaacaaaggtgtcagaggtgagagaccttttggagcatcacaggagccaaattccaactggggaaggggttcctctgactcctgtggggtggggacgaggtgtcacagcatggccttctcagttttctggggaagaaacccaagatgcctgactttctgccttggagactgaaagaaacaagggcaactcaccaaacaataagtgtttaactgaatcccctagatactattattagcagaaaaatgtaactgtattttatgatgagaaatgaggagttttgtgtgtgtgtgtgtgtgtgtgtgtgtgttggggatggggttactccctctgtcacccaggctggagtgcagtggtaccattacagctcactgcaacctctgtctcctgggtttaagtgatcctcgtgcctcagcctcccaagtagctgggactatgggcacaagctaccatacccagctaatttttttttttttttttttttttgagacggagtctcgctgtcgcccaggctggaatgcaatggcgcaatctcggctcactgcaagttccgcctcccgggttcacgccattctcctgcctcagcctcccgagtagctgggactacaggcgcccgccaccacacccagctaattttttgtatttttagtagagacagggtttcaccatgttagccaggatggtctcgatcttctgacctcgtgattcgcctgcctcggcctcccaaagtgctgggattacaggcatgagccaccacgcccggccttaatttttgtttttaaagagacagggttttgccatgtcacccagtctggtctcaaactcctagacttaagtgatctgcctgcctcgcctcccaaagtgttgggattacaggcttaagccaccctgcctggctgaaaaaatgagaagttttgaccataattaatgatcaatagaatagaaaaaaggaaggaaggaaggaaggaaggaaggaggaaggaaggaaggaaggaaggaaggaaggaaggaaggaaggaaggaaggagagagacaggaaggaaggaagggcaaagtaatgagacccttctctataggatgaaagctggtctctgggtagctgttggtgaccccttggaatctttgtatctaccccttgcttctccagatgctgcatgtttgcttttacaaggggagtggcatccctgacctttctcttataaatcgcctggctgaggttggacatgtgatatcagctgggaatctggaaggttggaagtccctccagatagggactggggacagctccaacccatgccatttccttgtccctcatgcaaccctccccttctctcccacctcctccttgacctgtcttctctcccatccctcaccctctctttgcccactgcttcattcagctttgaccacctctcctaattcctagattagaagttcttggaaaaaactgagagccgcattccatccctgcagaaggatttaacacatgtgtggtctggttgttgtgagggagggagtaccgcaagatggatattgctagagcctgtaccctgctcctgggatgtccccgtctctgtcctggggcgattgcttctccctcctgaatagtcaggggagagtgtcaccttgacagaggggtttacagtgtcaccattgtcaccaccagagggcagcagccagccagacctctgcttctctcaaggtcttgtctcctggctctctttatctttccaaatcttgtcccagctgcttctggtctcattcaaccccaggagcacaggtgggagagtagagaggcactggaagctgtaggtggtgtcctttgccactgtcttggtgaagtccccaagaggttaaacccagttcccaaagccacaccaaagtcttgccaagatttcaacctgactcttctgtgtgactgccggacccctgagagcaacagggaggccattcccagatcatctgtgagacctggctgggggtcccagaccccagctatggtatagtaagctttggtcagctccttcctttttgagggcatgaggaaggcaaagctgcagtcaagcgttcatgaagcagtctatgccccatgtaaacagcgtggctggttagttaacctctctgagcccttctcattggctgaattcatgactgatgagtagtgagagaatatgagtgaaggtgatttgtaaactatgatgtgtcaaacacatttaagggacaatgatgatactagagaaaaaacactggactcaggctcagatgtgggtttgagatctgtctgccatttacagtgggtgacttttgggaaagtcagttaacttctctgggtctccaataccatctgaaacctctctagagttgtaggcactgggcctatttgaggggttgtttttgctaagaccctgggaatgcctcctgtagctcagcagaaggaccagggccaggtgggtattcctggtggaagcaaagtcagctgactgggcaccctcaaatgaacttttgtggttgtcaggaacgtgtgacgacggctggaggccaacagagtccctacaggtggtgctcacggtaatgcaccgacaatgagtggctgttttccagtttctggcctccgctgcctatctagggtaagtgggtccctccaggggtctcctaggatgaggcctcagcccccagtttcccatcacctttccatagggccttgggagaggccctatccagcccgttttaggtttaccctcacctctactggggcttcattaattcctagaagcttccatcccaggtgtggggtcctgatgctttatatctgcaatttgaaggatcctgggccactgaaatgcccactggatgttgatgagaccagagggtgactctagggatgaggtggaagggacagcttggttagggaggcagatagccaatcgaaatcccagctccgaaatgaggagcttgggtttctgtttcacaaggtgtgccaggccataagcacaccaggaatatgagagaggggcttaggaagaaaccagaaagagaaacaatcccatctcaattaactggggtgggagctgggcgggagaaaagcagtgtgtgggtatctggaagctgcatgtcacctgctcactgcccctctgcgcctctcacacactggcaggcaaaggtgatggaaacttgctgccaagggctcttgctgcctccattgcttgcctttccttgtgcccagacatgtcccctcttgtcctctgtcctctcccatgctgcctaccaccctcccctccaacaagaatctggcccaaggtctccgcttcctggaactcccttatccctacccctactctgtcttcctgtccagcagtctgtctccaagatcccctagaatgacctcctctcagccctctcctccacaccccccaagtccccactacctggcccctcccactcctctgccttttcagccactgctgctctcttctcttctcccttacctgtctcccaggtgtgtcatggcctggtgcgggaggctcttacctccccaagccccactgcttctcctgctgcccgcttgcttcggactctggcagaaaccccacctgctgacacgttcctcctggggaattggcaagtgattagtgatgagctgtcagcacagggccctaaaactccccgaagaagctgtgccccatccctagacccctgttcagtgccattgggctagaagcagctcccagagagccatagattccccatggcccaaaaggagaatgaggaaactggtccagttgggtggatgggtggttggtttcccttgactctacctcagggaatgagggaggggagagttcccaccaccctttcttgatccacaccaacaacaggggccactggaagtctccaaaacagtccagtccagaaacctccccaaagtggtgatccttggaagctgctcttcccttcttttgacccttgttaagccccattggccctcgatgagagtaggggaaacaggtgccgagaagccctctgggcataaaccccactgcagttaactaagaggtgccactggagtagtcagggaaggctggggatagaggtggtggcattgggtactcctcccagcttaaccagacttgggtcctcctcaggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactccctt

SEQ ID NO: 14644 - DNA, 7175 bp, Homo sapiens
aagcaggggagaaagtgcgttttttatttatagggccatctgcaaaaggggcaaactgtctgtcaccacccgctccaccaactttacgggcgggggtgggggtagggagtcattcctcccgccaacccccgcaatcctcagtaacctataatctggggaaaagggtcccgagggctgggtcatcccgtgcctcccactgggtttaggacgcgacagcggaatgggcaggaggtggaggtgcacttctgcaaatctcaagaaccgaagccctggaggcggcggatgagaaagtccacagccctagcaattttgggtgtgtaggcagggatttagcgtatgtccacagccgctctagtgagggtgcccccacccacgttcctcggaagggcagcgctccatccccaccctgctaccctttccccgagagcctaatcccaccttagctggcgctcccggagcctccggggcaggagggaggcgtggcctcgggcggcccgcccctttgatgtgcgccggcaccgctgcgattggacagtcgcttgtgacgttggggactgcggtgggctccgctgctgcagcagccgcagcgccggccgcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgtgagtcctgggctccgggagataggggagggctggggtcccggcgcggggtgggggctgtggagtttgaaggcgctccttcacgcgcgtggcactgggggagttctggagctcaggagtgagtccccttctctctcctacccaggaacatagtgctggggtatccctccgtccccgactctgacaaagccaaggaattggtgtccccttgctccctgccacccacaatacccctccccgagccgcgcaccccccgcccgcattggagcccagcgcccgccagccgggggtgcgccagagtgctggcttcctagtcacctctaaaaatatctctcccccaaccctaccggcagctgccacctccctgcccctgcccctgcccctaggatcccctcccagcttgtcctcccacccagggagtgcccagaggtgactgctagacccagacgcctcactggcaccagggcgcagggccaccaccgccagctggtcaggaccgcaagctccctgcccactggagtctccagggccaaggggggagctccagctgcaattttcccaagaggcgccagagactcctgagttctaatcgcggttccgatgctgtgtgacccctaggatgttagcctgacctctctgggcctctgtttttcctatctgctgctcgggcgtggtgagcaaggaagatggtcatgtttgggagcactgtctgggaaagggagggaattctagcttagttgttggatctgatttctagtgattgatacaaggagacttgtttttggacagagagggcttgttactgtggtctttctggagtcctcgcctccccatcctcattctgcacatttcctttggaaaactatcccaaaacttttctaggaactccatctgcccagtaagaggggaatttgaaacttagggcctgtatcagagaggggcctgtttccctcccacccccttcccacagatttaatctaagagcatttgtgtgaaaggcgggagaagcaggcagggatctgtgacccggtgcagaattaaggaggcaggcactgcttttaggtgggactagaatatggactccctgcaaccccccagaagcccttctccctgctctggcctgtgagagaagctcagatcctgccccctactctgagggactctgtttggtgaccacaaaaggatttgatgactcagaacaaaggtgtcagaggtgagagaccttttggagcatcacaggagccaaattccaactggggaaggggttcctctgactcctgtggggtggggacgaggtgtcacagcatggccttctcagttttctggggaagaaacccaagatgcctgactttctgccttggagactgaaagaaacaagggcaactcaccaaacaataagtgtttaactgaatcccctagatactattattagcagaaaaatgtaactgtattttatgatgagaaatgaggagttgtgtgtgtgtgtgtgtgtgtgtgtgttggggatggggttactccctctgtcacccaggctggagtgcagtggtaccattacagctcactgcaacctctgtctcctgggtttaagtgatcctcgtgcctcagcctcccaagtagctgggactatgggcacaagctaccatacccagctaattttttttttttttttttttttgagacggagtctcgctgtcacccaggctggaatgcaatggcgcaatctcggctcactgcaagttctgcctcccgggttcacgccattctcctgcctcagcctcccgagtagctgggactacaggcgcccgccaccacacccagctaattttttgtatttttagtagagacagggtttcaccatgttagacaggatggtctcgatcttctgacctcgtgattcgcctgcctcggcctcccaaagtgctgggattacaggcatgagccaccacgcccggccttaatttttgtttttaaagagacagggttttgccatgtcacccagtctggtctcaaactcctagacttaagtgatctgcctgcctcgcctcccaaagtgttgggattacaggcttaagccaccctgcctggctgaaaaaatgagaagttttgaccataattaatgatcaatagaatagaaaaaaggaaggaaggaaggaaggaaggaaggaaggaaggaaggaaggaaggaaggaaggagagagacaggaaggaaggaagggcaaagtaatgagacccttctctataggatgaaagctggtctctgggtagctgttggtgaccccttggaatctttgtatctaccccttgcttctccagatgctgcatgtttgcttttacaaggggagtggcatccctgacctttctcttataaatcgcctggctgaggttggacatgtgatatcagctgggaatctggaaggttggaagtccctccagatagggactggggacagctccaacccatgccatttccttgtccctcatgcaaccctccccttctctcccacctcctccttgacctgtcttctctcccatccctcaccctctctttgcccactgcttcattcagctttgaccacctctcctaattcctagattagaagttcttggaaaaaactgagagccgcattccatccctgcagaaggatttaacacatgtgtggtctggttgttgtgagggagggagtaccgcaagatggatattgctagagcctgtaccctgctcctgggatgtccccgtctctgtcctggggcgattgcttctccctcctgaatagtcaggggagagtgtcaccttgacagaggggtttacagtgtcaccattgtcaccaccagagggcagcagccagccagacctctgcttctctcaaggtcttgtctcctggctctctttatctttccaaatcttgtcccagctgcttctggtctcattcaaccccaggagcacaggtgggagagtagagaggcactggaagctgtaggtggtgtcctttgccactgtcttggtgaagtccccaagaggttaaacccagttcccaaagccacaccaaagtcttgccaagatttcaacctgactcttctgtgtgactgccggacccctgagagcaacagggaggccattcccagatcatctgtgagacctggctgggggtcccagaccccagctatggtatagtaagctttggtcagctccttcctttttgagggcatgaggaaggcaaagctgcagtcaagcgttcatgaagcagtctatgccccatgtaaacagcgtggctggttagttaacctctctgagcccttctcattggctgaattcatgactgatgagtagtgagagaatatgagtgaaggtgatttgtaaactatgatgtgtcaaacacatttaagggacaatgatgatactagagaaaaaacactggactcaggctcagatgtgggtttgagatctgtctgccatttacagtgggtgacttttgggaaagtcagttaacttctctgggtctccaataccatctgaaacctctctagagttgtaggcactgggcctatttgaggggttgtttttgctaagaccctgggaatgcctcctgtagctcagcagaaggaccagggccaggtgggtattcctggtggaagcaaagtcagctgactgggcaccctcaaatgaacttttgtggttgtcaggaacgtgtgacgacggctggaggccaacagagtccctacaggtggtgctcacggtaatgcaccgacaatgagtggctgttttccagtttctggcctccgctgcctatctagggtaagtgggtccctccaggggtctcctaggatgaggcctcagcccccagtttcccatcacctttccatagggccttgggagaggccctatccagcccgttttaggtttaccctcacctctactggggcttcattaattcctagaagcttccatcccaggtgtggggtcctgatgctttatatctgcaatttgaaggatcctgggccactgaaatgcccactggatgttgatgagaccagagggtgactctagggatgaggtggaagggacagcttggttagggaggcagatagccaatcgaaatcccagctccgaaatgaggagcttgggtttctgtttcacaaggtgtgccaggccataagcacaccaggaatatgagagaggggcttaggaagaaaccagaaagagaaacaatcccatctcaattaactggggtgggagctgggcgggagaaaagcagtgtgtgggtatctggaagctgcatgtcacctgctcactgcccctctgcgcctctcacacactggcaggcaaaggtgatggaaacttgctgccgagggctcttgctgcctccattgcttgcctttccttgtgcccagacatgtcccctcttgtcctctgtcctctcccatgctgcctaccaccctcccctccaacaagaatctggcccaaggtctccgcttcctggaactcccttatccctacccctactctgtcttcctgtccagcagtctgtctccaagatcccctagaatgacctcctctcagccctctcctccacaccccccaagtccccactacctggcccctcccactcctctgccttttcagccactgctgctctcttctcttctcccttacctgtctcccaggtgtgtcatggcctggtgcgggaggctcttacctccccaagccccactgcttctcctgctgcccgcttgcttcggactctggcagaaaccccacctgctgacacgttcctcctggggaattggcaagtgattagtgatgagctgtcagcacagggccctaaaactccccgaagaagctgtgccccatccctagacccctgttcagtgccattgggctagaagcagctcccagagagccatagattccccatggcccaaaaggagaatgaggaaactggtccagttgggtggatgggtggttggtttcccttgactctacctcagggaatgagggaggggagagttcccaccaccctttcttgatccacaccaacaacaggggccactggaagtctccaaaacagtccagtccagaaacctccccaaagtggtgatccttggaagctgctcttcccttcttttgacccttgttaagccccattggccctcgatgagagtaggggaaacaggtgccgagaagccctctgggcataaaccccactgcagttaactaagaggtgccactggagtagtcagggaaggctggggatagaggtggtggcattgggtactcctcccagcttaaccagacttgggtcctcctcaggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactccctt

SEQ ID NO: 14645 - DNA, 136 bp, Homo sapiens
tttttttttttttttttgagatggagtgttgctctgtcgcccaggctggagtgcagcatgatcttggctcactgcaacctctgcctcccgggttcaagtgattctcctgcctcagcctcccgagtagctgggatta

SEQ ID NO: 14646 - DNA, 496 bp, Homo sapiens
tccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaagggggaagaaa

SEQ ID NO: 14647 - DNA, 46 bp, Homo sapiens
gtctccctatgttgtccaggctggtctcgaactccggggctcaagc

SEQ ID NO: 14648 - DNA, 496 bp, Homo sapiens; identical to SEQ ID NO: 14646

SEQ ID NO: 14649 - DNA, 165 bp, Homo sapiens; identical to SEQ ID NO: 7989

SEQ ID NO: 14650 - DNA, 143 bp, Homo sapiens; identical to SEQ ID NO: 7217

SEQ ID NO: 14651 - DNA, 151 bp, Homo sapiens; identical to SEQ ID NO: 7218

SEQ ID NO: 14652 - DNA, 202 bp, Homo sapiens; identical to SEQ ID NO: 7316

SEQ ID NO: 14653 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 14654 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 14655 - DNA, 195 bp, Homo sapiens; identical to SEQ ID NO: 7996
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c

SEQ ID NO: 14656 - DNA, 77 bp, Homo sapiens; identical to SEQ ID NO: 7322

SEQ ID NO: 14657 - DNA, 152 bp, Homo sapiens; identical to SEQ ID NO: 8280

SEQ ID NO: 14658 - DNA, 165 bp, Homo sapiens; identical to SEQ ID NO: 7989

SEQ ID NO: 14659 - DNA, 143 bp, Homo sapiens; identical to SEQ ID NO: 7217

SEQ ID NO: 14660 - DNA, 151 bp, Homo sapiens; identical to SEQ ID NO: 7218

SEQ ID NO: 14661 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 14662 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 14663 - DNA, 195 bp, Homo sapiens; identical to SEQ ID NO: 7996
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c

SEQ ID NO: 14664 - DNA, 152 bp, Homo sapiens; identical to SEQ ID NO: 8280

SEQ ID NO: 14665 - DNA, 165 bp, Homo sapiens; identical to SEQ ID NO: 7989

SEQ ID NO: 14666 - DNA, 143 bp, Homo sapiens; identical to SEQ ID NO: 7217

SEQ ID NO: 14667 - DNA, 151 bp, Homo sapiens; identical to SEQ ID NO: 7218

SEQ ID NO: 14668 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 14669 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 14670 - DNA, 195 bp, Homo sapiens; identical to SEQ ID NO: 7996
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c

SEQ ID NO: 14671 - DNA, 4493 bp, Homo sapiens
aggaggcagagggggcgtcaggccgcgggagaggaggccatgggcgcgcgcggggcgctgctgctggcgctgctgctggctcgggctggactcaggaagccgggtgagctcggggcgctgctggcgggatggggaggcgggggagcggtggggaggacgggaggtggaggccgcggggagtcacttcttgtctcccgcagagtcgcaggaggcggcgccgttatcaggtagggcgcccaggacgcgcgattcctgccagggccgttgggccgaggtggacggggggcggtgagggggtagaggggggcctttactgctctctcgcccccgcccccgggatcgagaactctgttggcgtggaaagtaactaacggacgctggagggggatgggcgggccctgcagagcacgtgggaggatctccagtgtcacctacttcctgctgcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacgtgagtgggggtgcgaacggaggggtgcggggacgggcaggaacagggctggagggagtgccaccgaactttacctctggtctgatgccagacttgggcgtgaaagttgtgcgtggatgcggcctggtgttctcctgagccccaggctgtgctgcagccggttacacccactccagttccctttgggtctcctggagggaaccctgttcaggttattccagaatgttcttccagaacatttccacacacttttgggtattctctccctttttctttcaacccaaagttcaccactgaccatcccaccctcatcccccctcctggtggacggtgcggtacagtgtggggcactgagccaaggccagcacccccgggccgctgtgtggactccatcctgccaatcccacattggcgtggtgcatctccccattcctccttgggctgcatgggggtgcccctggaggccttggctcaatgcaaggctccttgggacagctctgggaggtgacaagaccccacccttctgctgcaggagcaggtcctaggactttggttgtggtctgtctgggctccttcatttctgcaggggaccctgggtgttagcaagtagcagcaacaccacagtttcccctcctgcactggaccccagttgtgctcaggtagccagccctccgtccagggcccctgactgctctcttctcttctgccagctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggtgaggctggggacaggcgggtcagggaggaactgtctttgttcacctgttcccctgcataggcacaatagccccctgcttggtctgggggtgcaggctatgcccctcttgcttgcagtctctcctcacctgccagggcagggaccaaacacccagttctctcccttccaggggctgtgggggccagaaggagagtgtgagagggaggccagtttggcgcaggcctgtgggtggtgcggtggtggaggggttctggagggcttggcgacataaacctcatacttggatttattcctgcatctttccacctcccccagtgctcaccaatgccccaggcatcaggctcctgggctgcctctccatgcctcccacacccaccctagctctggccgattctcctgcagcactgagcccattcctctccccagaaacttccaagccatgctcaaccgcagctcccacggaaacccctctgggggttcctctggtgggcctgccctggcacctgcgtgtcccccaacacacatgccctgaaagaagtgggcccagcatccggaggagccccggcagccccagactgggcgtgttccctgtatcaggaatcccttccctctgctcccctgtctggcccgtccctgcatcatcccacaacagtagtaacaataacaaacgtggttccttgagcacacgctgtgtgcctggcactgttctagccatgggggcccagcagtgagccaggcgcggcctctcctcctgctggagctcacctaggaatgaagttggtaacgttcttatacccatcttacagatgagaaaactgagagggttatggaaattgccaagaactagtaaatggagaagtcagggccccttgccttagagagggtaagggatgtccccaagtcacaccccggcagttgggagtggggaactcagcactggagccgcctccctctggaggagggatcctttgccttccctgagaaggacccttgctgcaaacacgagtggatatgagccaggggcacggccaggctgcctctgccaccctctctccccagcccagggtagacaggtcacaccaaccccaggctgtgcctcaattcacagtgccggggaggcaggggacaggcacttctggagccccctgcctggtgtgcacctttgctgtgccctgcgcgggctgggaggccttgggcaaaggtgttcatcttacagtgcctcagtttcctcccctgtgaaataggggaatgatggtgccacatcagaggctagttcccaggttgttagtcccgagggcttaggagaggccccgctgacgggaagcgctgcctgcaggttgggtctcattgtcttttgtcatcctctgcaggacaaggtgctggctggcactctgaggcaggaattggacaggtgtgggctcctgtcaggctctgaaacttccccagtgccttgctgggggtcagcggggcaatatccccctgactctccttatctgggagtaggtcctgatgactgccgcctcccaggggtgctgggggtccctaagagtgctgcaacaagcttgtgtccaggcctggaaagcgcccagctgctactgaggccagggctgcagccaggctgcccctcccccaggtctggctttggatgctcatctgaacaccgtctcagctgccttcgcccctccctcggctccttttggctgaggaatctctccatggctgcaggcagggccattgttgccattctacagatagggaaagtgcggctgggggagctctgacagcctgtccctccccggggccttctgtgatgctgctgagggcctctgttgtgctggggtctgggttggagctgggggtaatggagatgaacctgccaggcacagtgggtgccccagggcccccacccccgcagcctatgccatccctccatagaggggcctcaggttgctgtctctctccttcccactatcgtccgcacagcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccttgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagca

SEQ ID NO: 14672 - DNA, 139 bp, Homo sapiens
gtgctggcgcgcgcctgtaaccccagctacttgggaggctgaggcaggagaatcgcttgaacccaggaggtggaggttgcagtgagctgggatcacgccaatgcactccagcctgggcgacaagagcgaaactccatct

SEQ ID NO: 14673 - DNA, 2112 bp, Homo sapiens
atttttaaaagatatcttttgtgtagaagtaacccaggaatgccagcatttgttttgatagtctcattccaatagtagttactttaaaatgaagaatgttcttaatttacaaaatattatgtatgtatttaagttatgaatattgcagatatgtaaatatgtgtatatgtgtgttgattttaatttgtatcttcacagattttattatcagttatgttttgaatttttacctttggagaaaacatactacttaaatcttccagtgtagtgatagcaaattatctttatataaattttattcagattattcaaagtaatcaaagatttttaattatttttattaaattaaatttatcagtataaataattaagatcattaaccttatttaattaaatttattaattttgattatagaaaaatgcattttcttcttaaatagattctttacacttaaagctgaagtgttattttgctacttgtatgtatatcagatactttgtttattaatctaatacgttagtaataaaaggagtactttacaattattgcctgtatattttttcatgtgtaggaaaatgaagaagattatgggacctgttctagttctgtacaatatacaccagtttacaaattacacaatgaaaagggaggaaactcagaaaagcgtaagcttgctcaggtaagtaaggttatttacccttcattcccccacattctcaaattatataattccagtaaattatttaggaacaatttggatccactaattttttatcttatatgaaaacctgcagtattggtcaaggggaggagttagtggaacctgggaaggctacaaggggattgagagtcaaatgtttcagatatcggtctctacatgctttgttagcccatgccctcatagatctcatagtccagtgaaggaaaagacaattgaatgtgtgattcttatagagtgtgaatagcttgatgataaactggaaatcataggattcctttactacaaaaataaaatcaatcttatacatgggtatttggccattaaaatagtctatagaaattaaaatctgaactactataagtctatcctattctaaagttagattattttatttgctataaatagttaaagcttctttttatatgctgatgctacttaaaatattgtttcaagtgactgagtgttcagaatcatagctataagtgttcctggtttttttttcataagtacatttatgaaggctctaactaaacaaaattggtatatacaaaattgtatcttaagtggccttagaaaactagcttcaaaaaagaattcttgagtggactgtagctacaaaattacagaactggaagtggctgcaaagcttcatttataacagttgccaaggtttgcagatgagaaagttgatagctagaatggtcacaacacttgccataagtctcataactgatcagtggcagaaggaggcgaaaagccatctctgatgctcagttagctttcctggatagccaggcaccacagaagtatacatggccataaggtgcttccagggtctttgtctttgagcccattttgtgctgctgtaccagaatacctgaggctgggtaatttgtaaagaacagaagtttatttctcacagttcgggaggctggaaagtccaagatcaaggcactggcaccttatgaggcccttcttgctgtgtcatcccatggtggaaggcagaaaggcaagagagatgagggggccaaactcacccttttataacagcactaatcccacccaagagggtggaaccctcatggcccaatcacctcttaaaagtcccacttcttaataccattacaatggcaattaaatttcaacatgagattttgagaggacaaaattcaaaccgtaacaacagtctttaagaatgggaaaggatagtgaagctgtactgaaactctagtcctttgtaaaaaaaaaaaaaaaaaaaaaaaaaatcccattaattcagtcattcatcaacactatatgccacacacttttctagataccaggtgtatataaaaggaaaacacaaaaattctctgctttcatgggactgtttttgtaacatactgagtat

SEQ ID NO: 14674 - DNA, 2112 bp, Homo sapiens
atttttaaaagatatcttttgtgtagaagtaacccaggaatgccagcatttgttttgatagtctcattccaatagtagttactttaaaatgaagaatgttcttaatttacaaaatattatgtatgtatttaagttatgaatattgcagatatgtaaatatgtgtatatgtgtgttgattttaatttgtatcttcacagattttattatcagttatgttttgaatttttacctttggagaaaacatactacttaaatcttccagtgtagtgatagcaaattatctttatataaattttattcagattattcaaagtaatcaaagatttttaattatttttattaaattaaatttatcagtataaataattaagatcattaaccttatttaattaaatttattaattttgattatagaaaaatgcattttcttcttaaatagattctttacacttaaagctgaagtgttattttgctacttgtatgtatatcagatactttgtttattaatctaatacgttagtaataaaaggagtactttacaattattgcctgtatattttttcatgtgtaggaaaatgaagaagattatgggacctgttctagttctgtacaatatacaccagtttacaaattacacaatgaaaagggaggaaactcagaaaagcgtaagcttgctcaggtaagtaaggttatttacccttcattcccccacattctcaaattatataattccagtaaattatttaggaacaatttggatccactaattttttatcttatatgaaaacctgcagtattggtcaaggggaggagttagtggaacctgggaaggctacaaggggattgagagtcaaatgtttcagatatcggtctctacatgctttgttagcccatgccctcatagatctcatagtccagtgaaggaaaagacaattgaatgtgtgattcttatagagtgtgaatagcttgatgataaactggaaatcataggattcctttactacaaaaataaaatcaatcttatacatgggtatttggccattaaaatagtctatagaaattaaaatctgaactactataagtctatcctattctaaagttagattattttatttgctataaatagttaaagcttctttttatatgctgatgctacttaaaatattgtttcaagtgactgagtgttcagaatcatagctataagtgttcctggtttttttttcataagtacatttatgaaggctctaactaaacaaaattggtatatacaaaattgtatcttaagtggccttagaaaactagcttcaaaaaagaattcttgagtggactgtagctacaaaattacagaactggaagtggctgcaaagcttcatttataacagttgccaaggtttgcagatgagaaagttgatagctagaatggtcacaacacttgccataagtctcataactgatcagtggcagaaggaggcgaaaagcatctctgatgctcagttagctttcctggatagccaggcaccacagaagtatacatggccataaggtgcttccagggtctttgtctttgagcccattttgtgctgctgtaccagaatacctgaggctgggtaatttgtaaagaacagaagtttatttctcacagttcgggaggctggaaagtccaagatcaaggcactggcaccttatgaggcccttcttgctgtgtcatcccatggtggaaggcagaaaggcaagagagatgagggggccaaactcacccttttataacagcactaatcccacccaagagggtggaaaccctcatggcccaatcacctcttaaaagtcccacttcttaataccattacaatggcaattaaatttcaacatgagattttgagaggacaaaattcaaaccgtaacaacagtctttaagaatgggaaaggatagtgaagctgtactgaaactctagtcctttgtaaaaaaaaaaaaaaaaaaaaaaaaaatcccattaattcagtcattcatcaacactatatgccacacacttttctagataccaggtatatataaaaggaaaacacaaaaattctctgctttcatgggactgtttttgtaacatactgagtat

SEQ ID NO: 14675 - DNA, 2111 bp, Homo sapiens
atttttaaaagatatcttttgtgtagaagtaacccaggaatgccagcatttgttttgatagtctcattccaatagtagttactttaaaatgaagaatgttcttaatttacaaaatattatgtatgtatttaagttatgaatattgcagatatgtaaatatgtgtatatgtgtgttgattttaatttgtatcttcacagattttattatcagttatgttttgaatttttacctttggagaaaacatactacttaaatcttccagtgtagtgatagcaaattatctttatataaattttattcagattattcaaagtaatcaaagatttttaattatttttattaaattaaatttatcagtataaataattaagatcattaaccttatttaattaaatttattaattttgattatagaaaaatgcattttcttcttaaatagattctttacacttaaagctgaagtgttattttgctacttgtatgtatatcagatactttgtttattaatctaatacgttagtaataaaaggagtactttacaattattgcctgtatattttttcatgtgtaggaaaatgaagaagattatgggacctgttctagttctgtacaatatacaccagtttacaaattacacaatgaaaagggaggaaactcagaaaagcgtaagcttgctcaggtaagtaaggttatttacccttcattcccccacattctcaaattatataattccagtaaattatttaggaacaatttggatccactaattttttatcttatatgaaaacctgcagtattggtcaaggggaggagttagtggaacctgggaaggctacaaggggattgagagtcaaatgtttcagatatcggtctctacatgctttgttagcccatgccctcatagatctcatagtccagtgaaggaaaagacaattgaatgtgtgattcttatagagtgtgaatagcttgatgataaactggaaatcataggattcctttactacaaaaataaaatcaatcttatacatgggtatttggccattaaaatagtctatagaaattaaaatctgaactactataagtctatcctattctaaagttagattattttatttgctataaatagttaaagcttctttttatatgctgatgctacttaaaatattgtttcaagtgactgagtgttcagaatcatagctataagtgttcctggtttttttttcataagtacatttatgaaggctctaactaaacaaaattggtatatacaaaattgtatcttaagtggccttagaaaactagcttcaaaaaagaattcttgagtggactgtagctacaaaattacagaactggaagtggctgcaaagcttcatttataacagttgccaaggtttgcagatgagaaagttgatagctagaatggtcacaacacttgccataagtctcataactgatcagtggcagaaggaggcgaaaagccatctctgatgctcagttagctttcctggatagccaggcaccacagaagtatacatggccataaggtgcttccagggtctttgtctttgagcccattttgtgctgctgtaccagaatacctgaggctgggtaatttgtaaagaacagaagtttatttctcacagttcgggaggctggaaagtccaagatcaaggcactggcaccttatgaggcccttcttgctgtgtcatcccatggtggaaggcagaaaggcaagagagatgagggggccaaactcacccttttataacagcactaatcccacccaagagggtggaaccctcatggcccaatcacctcttaaaagtcccacttcttaataccattacaatggcaattaaatttcaacatgagattttgagaggacaaaattcaaaccgtaacaacagtctttaagaatgggaaaggatagtgaagctgtactgaaactctagtcctttgtaaaaaaaaaaaaaaaaaaaaaaaaaatcccattaattcagtcattcatcaacactatatgccacacacttttctagataccaggtgtttataaaaggaaaacacaaaaattctctgctttcatgggactgttttgtaacatactgagtat

SEQ ID NO: 14676 - DNA, 192 bp, Homo sapiens
tttttctctgagacggagtcttgctctgtcccccaggctggagtgcagtggtgcgatctcggctcactgcaagctccgcctcctgggttcacgccattctcctgcctcagcctcccaagcagctgggactacaggcacccgccaccacgcctggctaattttgtttttgtatttttagtagagacggggttt

SEQ ID NO: 14677 - DNA, 154 bp, Homo sapiens
tgagacggagtcttgctctgtcccccaggctggagtgcagtggtgcgatctcggctcactgcaagctccgcctcctgggttcacgccattctcctgcctcagcctcccaagcagctgggactacaggcacccgccaccacgcctggctaatttt

SEQ ID NO: 14678 - DNA, 154 bp, Homo sapiens; identical to SEQ ID NO: 14677

SEQ ID NO: 14679 - DNA, 450 bp, Homo sapiens
cagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgcttaaa

SEQ ID NO: 14680 - DNA, 375 bp, Homo sapiens
taacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttca

SEQ ID NO: 14681 - DNA, 4702 bp, Homo sapiens
gtgccaatgttggccagtcgcggtggttcacgcctgtaatcccagcactttgggaggctgaggtgggtggatcacgaggtcaggagattgagaccatcctggctaacacggtgaaaccccatctctactaaaaatacaaaaaaattagccgggcatggtggcagacacctgtagtcccagctactcgggaggctgaggcaggagaatggtgtgaaccccggaggcggagcttgcaatgagctgagattgtgccactgcattccagcctgggcgatagagcgagactccatctcaaataaataaataaataaatagtgccaatgttatgaccagaggcagcaaggcctgacacagcatccaaggccagtctgggcacctgctcttttgcacattaatataataagctttaacaagaaatacatgttaactttctcaggatcaaaggattcagaaggctattttgctctcattttatccttaggcttcagcagaagaaacacttcctataaatctcgcccaaacaggaaaggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcaccggcacaagcacgcacactgtgatggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatgtaatatgtcatttttgttaatagtgtctttttgtcattttactttttaaaagattgtattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcatttgtacagttgcatattagtttgcagatccctcactctcgtttctatatggtattatattgcataaacgtaccacactttatctaactactgttaaatatttgtgcatcttctacttgggggcgatttcaaatagtgctgctatgaacattcttgtaaatgtcttttggtgaacatatgcaacacatatatgcgttgttgttggttcccaggaggggcattcctgggtcataaacaatgcatgtgttcaggtttagtatggtataatgccaaacaggtttccaaagtgtttgtgccactttacatacccgccattattgaaaaagagttctgtttgctccacattttcaccaatacttgatattttgtttttttttcttttaaaccgtactagtgggtgtgcagtgatattgcaatgtggttttaatttgcatcttccttgtgacaaattaaccttgattactgtaagccacttggaaatgtgatttaaattcatataaagatatagtagcaaaacacatagtaagttactttcatatccagaaagtttagatagaatgatttctatgtaagcttttactgtgtagtctgagtccatgaatattgattacaaaaaacacatctgtaggtgagttacaatacctcacttataattcaaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacagacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagcccagcagagggggaaagcattggccccaggccaaaatcataaacgctttcaattaactaataataattgctggcatgttgccattaaatatccttgtctcattatccctggttgcttcatcagacccataggtcactgaagcccacttttgagacaaagactatttctcccccaaaagtcaagggaaatataaaaagtgaaattagtgattaagcatagaagtcaattaatacaatcattttgtcttaattatttaaagtccagtttttttcctccagcaaacctgaaaatacactatcctccagctatcagaattatattgagatctactcacatttatgatgatgttcagagattcatcattgggaaggaaaatgcacacgctgcggcggtcttgcatgactctgttgtggaaattcaatttgttcattgtgttttgggctctctgggtggtcagggctgggctctgggtccttggcaattcctcaggttcccagcactccaaagccaagctcacctcctcatcacacgccctgcaggagaagcatcagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccacaaagttttaaagctttcatccacagtcaggaattaaacttataccaatgagagcctcacacattcaaggatgtactaagcactacaggcctcacagaaacagagatcccatcttggagttttcagtcccacatgggagataaagggttttgaacatgaaatgacaaaaacaacagcaagaagaaaattctcgtcctttttcattactatcaaactcaaataaatgtcttggctcttacattacattcattcttcaaccattgtggtctggcttccacttccttcacttcaccaacatggctctgccaaaggaagcctgtgatctctaggccatcactttaattgatctctctacaacatttatcctggtcgttaagccctccttacaacattcttctctctttgtttttatggctctgtctctcctgcttctttaacctgataatgcatacttgatttttccatttattatttcatcaaccaattaatacacagataaaacaagactgtgtatatcaaaccatgtttgtatagaaaaaatggattttggatgcctctcatatgtaattagttctattaaacatattaattgtattgtttaatttatcaggtttttgacacagagaattttgtttgcaagtaataaaaattttatctccaattttcaataattacacccattatttctgttttatgtctcattgcattggtgagatcttgcagaataattttagaacagtagtgggtattttctacttttaatgggtgtgtctagtatttcatatattgttgcttatagaacactattcaaccaagacatgtcaagactagttgtctctcaaaccattagtatttatattattcctttccagctacatttgtgggatgtaaaagaccatttccaggaatatggaactgttttactaggtggagggtatatataaccatacaatagtcacagaaactacattaatactcacataaatcaaagcataaatgacatagaatcttggcagatttgcttaaggttaaatgtataactcttatcagcaggaggtgaaagaatatattcttagatacttggcacatttagaaaatataatctaatattctttttaaagaacaggccgggcacggtggctcacgcctgtaatcccagcactttgggaggccaaggcgggcggatcacgaggtcaggagatccagaccatcctggataacacagtgaaaccccgtctctaccaaaaatacaaaaaattatctgggcatggtggcgggcgcctgtagtcccagctactcgggaggctgaggcaggagaatggcgtgaacccaggaggtggagcttgcagtgagccgagatcacgccactgcactccggcctgggcaaaagagcgagactccgtctcaaacaaacaaa

SEQ ID NO: 14682 - DNA, 4721 bp, Homo sapiens
gtgccaatgttggccagtcgcggtggttcacgcctgtaatcccagcactttgggaggctgaggtgggtggatcacgaggtcaggagattgagaccatcctggctaacacggtgaaaccccatctctactaaaaatacaaaaaaattagccgggcatggtggcagacacctgtagtcccagctactcgggaggctgaggcaggagaatggtgtgaaccccggaggcggagcttgcaatgagctgagattgtgccactgcattccagcctgggcgatagagcgagactccatctcaaataaataaataaataaatagtgccaatgttatgaccagaggcagcaaggcctgacacagcatccaaggccagtctgggcacctgctcttttgcacattaatataataagctttaacaagaaatacatgttaactttctcaggatcaaaggattcagaaggctattttgctctcattttatccttaggcttcagcagaagaaacacttcctataaatctcgcccaaacaggaaaggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcaccggcacaagcacgcacactgtgatggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatgtaatatgtcatttttgttaatagtgtctttttgtcattttactttttaaaagattgtattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcatttgtacagttgcatattagtttgcagatccctcactctcgtttctatatggtattatattgcataaacgtaccacactttatctaactactgttaaatatttgtgcatcttctacttgggggcaatttcaaatagtgctgctatgaacattcttgtaaatgtcttttggtgaacatatgcaacacatatatgcgttgttgttggttcccaggaggggcattcctgggtcataaacaatgcatgtgttcaggtttagtatggtataatgccaaacaggtttccaaagtgtttgtgccactttacatacccgccattattgaaaaagagttctgtttgctccacattttcaccaatacttgatattttgtttttttttcttttaaaccgtactagtgggtgtgcagtgatattgcaatgtggttttaatttgcatcttccttgtgacaaattaaccttgattactgtaagccacttggaaatgtgatttaaattcatataaagatatagtagcaaaacacatagtaagttactttcatatccagaaagtttagatagaatgatttctatgtaagcttttactgtgtagtctgagtccatgaatattgattacaaaaaacacatctgtaggtgagttacaatacctcacttataattcaaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagcccagcagagggggaaagcattggccccaggccaaaatcataaacgctttcaattaactaataataattgctggcatgttgccattaaatatccttgtctcattatccctggttgcttcatcagacccataggtcactgaagcccacttttgagacaaagactatttctcccccaaaagtcaagggaaatataaaaagtgaaattagtgattaagcatagaagtcaattaatacaatcattttgtcttaattatttaaagtccagtttttttcctccagcaaacctgaaaatacactatcctccagctatcagaattatattgagatctactcacatttatgatgatgttcagagattcatcattgggaaggaaaatgcacacgctgcggcggtcttgcatgactctgttgtggaaattcaatttgttcattgtgttttgggctctctgggtggtcagggctgggctctgggtccttggcaattcctcaggttcccagcactccaaagccaagctcacctcctcatcacacgccctgcaggagaagcatcagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtcccacatgggagataaagggttttgaacatgaaatgacaaaaacaacagcaagaagaaaattctcgtcctttttcattactatcaaactcaaataaatgtcttggctcttacattacattcattcttcaaccattgtggtctggcttccacttccttcacttcaccaacatggctctgccaaaggaagcctgtgatctctaggccatcactttaattgatctctctacaacatttatcctggtcgttaagccctccttacaacattcttctctctttgtttttatggctctgtctctcctgcttctttaacctgataatgcatacttgatttttccatttattatttcatcaaccaattaatacacagataaaacaagactgtgtatatcaaaccatgtttgtatagaaaaaatggattttggatgcctctcatatgtaattagttctattaaacatattaattgtattgtttaatttatcaggtttttgacacagagaattttgtttgcaagtaataaaaattttatctccaattttcaataattacacccattatttctgttttatgtctcattgcattggtgagatcttgcagaataattttagaacagtagtgggtattttctacttttaatgggtgtgtctagtatttcatatattgttgcttatagaacactattcaaccaagacatgtcaagactagttgtctctcaaaccattagtatttatattattcctttccagctacatttgtgggatgtaaaagaccatttccaggaatatggaactgttttactaggtggagggtatatataaccatacaatagtcacagaaactacattaatactcacataaatcaaagcataaatgacatagaatcttggcagatttgcttaaggttaaatgtataactcttatcagcaggaggtgaaagaatatattcttagatacttggcacatttagaaaatataatctaatattctttttaaagaacaggccgggcacggtggctcacgcctgtaatcccagcactttgggaggccaaggcgggcggatcacgaggtcaggagatccagaccatcctggataacacagtgaaaccccgtctctaccaaaaatacaaaaaattatctgggcatggtggcgggcgcctgtagtcccagctactcgggaggctgaggcaggagaatggcgtgaacccaggaggtggagcttgcagtgagccgagatcacgccactgcactccggcctgggcaaaagagcgagactccgtctcaaacaaacaaacaaacaaataaataaataa

SEQ ID NO: 14683 - DNA, 5977 bp, Homo sapiens
aacagtaatggtaattttgttttcataaataaaattttaaattgaatatctacaagccggtcatagcatatgcttctccaagcagaagagagtgtaacacttgtcaggcactagctctgtctctaaaatgaggcatgggtgcctcctcaccagttagcaatttcctaaagcaaagtcttgttaataccttgcagtaggagcatcttcaagaataacaatcttttggccgggtgcggtggctcacgcctgtaatcccagcactttgggaggccgaggcaggtggatcacgaggtcaggagatcgagaccacggtgaaaccccgtctctactaaaaatacaaaaaattagctgggcgtggtggcgggcgcctgtagtcccagctactcgggaggctgaggcaggagaatggcatgaacccaggaggcagaacttgcagtgagccgagatcgcgccactgcactccagcctgggcgacagagcgagactctgtctcaaaaaaaaaaaaaaaaaaaaaggataacaatctttccacacacttttcacgtggacttcagagtgggaacgcctcttttctgaggaccccgcccccaacccctgctgctgagtaggcagatacaccagcgggcaaaacggatgggtcccggcctcatggttcttcaagcagtaagactcggctgagttcatcaacagctgtgatttcaacaggacgagggccatgtcgtgacccccacgtcccccaagtcaggatggcacgccacccccaggccacctgcagccttacctgccccgagtccgtgaccgccaggcagtgcagggccccgacagccacatgcacgatcttcttccctctcagcccttccaccacctacagtttccacacgtgcacgtcagagccctggcgcaacctgaagtaatccccctttcccctgagaaggaggcccgtggtggagtgttacaatatagttgtggtctgacaatgctatacaagaagacactcattgtctcacatctttcacagccagctcaatgacatcacacacagcacccaaggtcttcgaacttgtattcaaaatcatacaccattaattcaaattaacttattaagtcagctgggaaaaaccttaataccttaatacatgttctacaatatttaagttactgttgtaggttttcatatagactgaaaataagacacattactgcaaacacctatccaaagtcctatctggtatacatctttctcagagtgccaatgtcggccagtagcagtggttcacgcctgtaatcccagcactttgggaggccgaggcgggtggatcacaaggtcaggagatcgagaccatcctggctaacatggtgaaaccctatctctactaaaaacacaaaaaaattagccgggcatggtggcagacgcctgtagtcccagctactcgggaggctgaggcaggagaatggcgtgaacccgggagacggagcttgcagtgagctgagattgtgccactgcattccagcctgggcgacagagcgagactccatctcaaataaataaataaataaataaataaatagtgccaatgttatgaccagaggcagcaaggcctgacacagcatccaaggccagtctgggcacctgctcatttgcacattaatataataagcttttacaagaaatacatgttaactttctcaggatcaaaggattcagaaggctattttgctctcattttatccttaggcttcagcagaagaaacacttcctataaatctcgcccaaacaggaaaggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacatagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcatttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcctttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaataattacacccattatttctgttttatgtctcattgcattgatgagatcttgcagaataattttaaaacagtagtgggtattttctgcttttaatgggtatgtctagtatttcatatattgttgcttatagaacactattcaaccaagacatgtcaagactagttgtctctcaaaccattagtatttatattattcctttccagctacacttgtaggatgtaaaagaccatttccaggaatatggaactgttttactaggtggagggtatatataaccatataatagtcacagaaactacattaatactcacataaatcaaagcataaatgacatagaatcttggcagatttgcttaaggttaaatgtataactcttatcagcaggaggtgaaagaatatattcttagatacttggcacatttagaaaatataatctaatattctttttaaagaataggccgggcacggtggctcacacctgtaatcccagcactttgggaggccaaggcgggcggatcacgaggtcaggagatcgagaccatcctggctaacacggtgaaaccccgtctctactaaaaatacaaaaaattagctgggcgcggtggcgggcacctgtagtcccagctactcaggaggctgaggcaggagaacggcatgaacccgggaggtggagcttgcagtgagccgagatcgcgccactgcactccagcctgggcgaaagagcgagactctgtctcaaaaaaaaaaaaaaaaaagaataaataaaa

SEQ ID NO: 14684 - DNA, 327 bp, Homo sapiens
acgtgcacgtcagagcggtggcccaacctgaagtaatccccctttcccctgagaggaggcccgtggtggagtgttacaatacggttatggtcttaccatgcgatacaagaagacactcattgtctcacatctttcacagccagctcaatgacatcacacacagcacccaaggtcttcgaacttgtattcaaaatcatacaccattaattcaaattaacttattaagtcagctgggaaaaaccttaataccttaatacatgttctacaatatttaagttactgttgtaggttttcatatagactgaaaataagacacactactgcaaa

SEQ ID NO: 14685 - DNA, 327 bp, Homo sapiens
acgtgcacgtcagagcggtggcccaacctgaagtaatccccctttcccctgagaggaggcccgtggtggagtgttacaatacggttatggtcttaccatgcgatacaagaagacactcattgtctcacatctttcacagccagctcaatgacatcacacacagcacccaaggtcttcgaacttgtattcaaaatcatacaccattaattcaaattaacttattaagtcagctgggaaaaaccttaatatcttaatacatgttctacaatatttaagttactgttgtaggttttcatatagactgaaaataagacacactactgcaaa

SEQ ID NO: 14686 - DNA, 208 bp, Homo sapiens
ctcttagaagtttacccaagagaatttcaagtggatgtccatacacaaacttgtatggaaatgtccattagcaatttcacttgcatagtcaaaaactggaaacagcccaaacattcatcaacagaaaaatggatgaacaaattgcatttgtttatcttaagatactattcaacaatttaaaagaataaactattgatacatgcaacgt

SEQ ID NO: 14687 - DNA, 4702 bp, Homo sapiens; identical to SEQ ID NO: 14681

SEQ ID NO: 14688 - DNA, 4721 bp, Homo sapiens; identical to SEQ ID NO: 14682

SEQ ID NO: 14689 - DNA, 5977 bp, Homo sapiens; identical to SEQ ID NO: 14683

SEQ ID NO: 14690 - DNA, 327 bp, Homo sapiens; identical to SEQ ID NO: 14684

SEQ ID NO: 14691 - DNA, 327 bp, Homo sapiens; identical to SEQ ID NO: 14685

SEQ ID NO: 14692 - DNA, 208 bp, Homo sapiens; identical to SEQ ID NO: 14686

SEQ ID NO: 14693 - DNA, 4702 bp, Homo sapiens; identical to SEQ ID NO: 14681

SEQ ID NO: 14694 - DNA, 640 bp, Homo sapiens; identical to SEQ ID NO: 8187

SEQ ID NO: 14695 - DNA, 606 bp, Homo sapiens; identical to SEQ ID NO: 8188

SEQ ID NO: 14696 - DNA, 4721 bp, Homo sapiens; identical to SEQ ID NO: 14682

SEQ ID NO: 14697 - DNA, 640 bp, Homo sapiens; identical to SEQ ID NO: 8187

SEQ ID NO: 14698 - DNA, 513 bp, Homo sapiens; identical to SEQ ID NO: 8191

SEQ ID NO: 14699 - DNA, 612 bp, Homo sapiens; identical to SEQ ID NO: 8192

SEQ ID NO: 14700 - DNA, 462 bp, Homo sapiens; identical to SEQ ID NO: 8477

SEQ ID NO: 14701 - DNA, 640 bp, Homo sapiens; identical to SEQ ID NO: 8187

SEQ ID NO: 14702 - DNA, 640 bp, Homo sapiens; identical to SEQ ID NO: 8187

SEQ ID NO: 14703 - DNA, 654 bp, Homo sapiens; identical to SEQ ID NO: 8195

SEQ ID NO: 14704 - DNA, 647 bp, Homo sapiens; identical to SEQ ID NO: 8196
  misc_feature (29)..(29): n equals a,t,g, or c

SEQ ID NO: 14705 - DNA, 5977 bp, Homo sapiens; identical to SEQ ID NO: 14683

SEQ ID NO: 14706 - DNA, 640 bp, Homo sapiens; identical to SEQ ID NO: 8197

SEQ ID NO: 14707 - DNA, 640 bp, Homo sapiens; identical to SEQ ID NO: 8198

SEQ ID NO: 14708 - DNA, 571 bp, Homo sapiens; identical to SEQ ID NO: 8199

SEQ ID NO: 14709 - DNA, 640 bp, Homo sapiens; identical to SEQ ID NO: 8187

SEQ ID NO: 14710 - DNA, 639 bp, Homo sapiens; identical to SEQ ID NO: 8201
  misc_feature (88)..(88): n equals a,t,g, or c

SEQ ID NO: 14711 - DNA, 648 bp, Homo sapiens; identical to SEQ ID NO: 8202

SEQ ID NO: 14712 - DNA, 624 bp, Homo sapiens; identical to SEQ ID NO: 8203

SEQ ID NO: 14713 - DNA, 509 bp, Homo sapiens; identical to SEQ ID NO: 8204

SEQ ID NO: 14714 - DNA, 654 bp, Homo sapiens; identical to SEQ ID NO: 8205

SEQ ID NO: 14715 - DNA, 546 bp, Homo sapiens; identical to SEQ ID NO: 8206
  misc_feature (20)..(20): n equals a,t,g, or c

SEQ ID NO: 14716 - DNA, 654 bp, Homo sapiens; identical to SEQ ID NO: 8195

SEQ ID NO: 14717 - DNA, 327 bp, Homo sapiens; identical to SEQ ID NO: 14684

SEQ ID NO: 14718 - DNA, 327 bp, Homo sapiens; identical to SEQ ID NO: 14685

SEQ ID NO: 14719 - DNA, 208 bp, Homo sapiens; identical to SEQ ID NO: 14686

SEQ ID NO: 14720 - DNA, 4702 bp, Homo sapiens; identical to SEQ ID NO: 14681

SEQ ID NO: 14721 - DNA, 4721 bp, Homo sapiens; identical to SEQ ID NO: 14682

SEQ ID NO: 14722 - DNA, 5977 bp, Homo sapiens; identical to SEQ ID NO: 14683

SEQ ID NO: 14723 - DNA, 327 bp, Homo sapiens; identical to SEQ ID NO: 14684

SEQ ID NO: 14724 - DNA, 327 bp, Homo sapiens; identical to SEQ ID NO: 14685

SEQ ID NO: 14725 - DNA, 208 bp, Homo sapiens; identical to SEQ ID NO: 14686

SEQ ID NO: 14726 - DNA, 1188 bp, Homo sapiens
gccaccctgctggttgcagtagagcttgtttgactatcttgtcccaagccctctgcacttccacccactccctccctctttccagaatttgggagcaggctcagaaaatgccatgccctgaaattccacctgataggaattgaagagaaatgaatgagcgattcccagcaggatcacttgccctaaaagatgaattgagccgagtttccgcagtgactgggtccttcccacacctcatcagtagactccaagccagaatgtaaatgaatgcaaagtgatctcattcactgagcttatccatcatggatattggtgccatgactgaagacggtgttcttgtccaagagtaagacttgtgcatgtgcttttcccctccactttcctggggagggaatggcctgatgctaccgaccagtccacattctctgaacagatgcatccccagagtgcacgtgagttcatcagcttctccaggttgatggacacatggcctgtgatgatgtttctcaaagtgtatgccacacagaacactagttcgtgagttgctccatgaaccaagggtgccatggtcagataagctgggaaatgctgcgtgctgcaccttccttagcaagattcatgtgcaaaggatctgagaagtcctgtgataccaggcttaccaatccatttggtcacatcacacaccccactcctcactgttttttggttttttttttttttttttgactaaacacactgtctcctagggacacagttctgtgtagttaacaggaaatatttattgagtttctatgtggcaggccctgaactaagctttcttttgtatgatttcatttgctccttaaagcaaccctgtgaaatttatatattgtcatcactcccattcgacaggtaaagcattcgaggcttggagagttcaagccactttccctcctcactcagccagtaagtggtagagccaggttcaaacccaggcctgcctccctccaaagtccactttatcatgcttccccagaagaaaatggccacttataataaaaaggtaaattagggccaggtgcagtggctcccgcctgtaatcccagagctttgggagaccaaggcaagaggatcatttgagcccaggtgttcaaggccagcctaggcaacataacgagaccctatctctacaaaaaaaaataataataa

SEQ ID NO: 14727 - DNA, 517 bp, Homo sapiens
ctccctacgtctgtgtgggttttctctgggtattgcggtttcctctcgtatcccaaaggtgtgcatattaggttcattggtgcgtctacatggctgcagtctgagtgagtgtggggtgtgagagatgccccgcgatggtgtcctatcctgggctggtgcccatcttgtgtcctgagctgctgggatgggctctgaccacccaagacccttaactgcaataaatgggtaaataattatttgctgttcttaatgaatctttcttaagctcatatttattctatgtatagtgcacatttatttccatgtttaatactagaagtgttttggtcttgagaagtttggtaggccaggtacaatggctgatgcctgaaatcccagcactttttgaggctaaggcaggaggatcacttgagcctgggaggtcaaagctacagtgagtatgccatgattccagcaccgcattccagcctgggtaacagagtgagacagaagaagaaagaagaaagaagaagaagaa

SEQ ID NO: 14728 - DNA, 5485 bp, Homo sapiens
ttttaggtaacaaatgtttgctgagcatctaatgatgatgacaataataactatgatctatggggcactggctatgggccagggcattgctaagagctccagatccttgatcttatctaatccacataagagcactatgagggaggtactgttatttttctcgttttacacacgaggacactgaagcagaatggtcaagaaggtggctcatggtccatatggggtacagccaggacccagcccatgatttcagctcccgtgcatgttccctccatccacagggcctggtgcagttctaggagctggggggatgaagaaaggaagccaaggtcttcaccctcaaacactcacagcttttgctggtagacacaaataagtaggcaattactagaagacatcaaagtgctgttttacagcaagggttggcagactgtttctgtgaagggccagacagtgaaggttttagagtctgcagggcaggcagtcgctgtcgcagctcctcagcaccaccactgcagctataaatgtatgggcatggctgggttcctataaaactttatttacaaaaacaggcctctggtgggatttggtcggtgggtggaggggtgtagcttgccccagttctggagggatgtggccaaagtgttctgtgaggacgctgtagtgaccctaaggagaggcacccaactccatcagggctcagggaaggcttcctggagggggtggcgcctgaatgagcatgagctggccgagacgaagagcagcctggctgaacgggtcgggtctcacaacacggtgctcatgaggaacgctcttaatgtgcacactgtcctgtgtctctgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggtgaggggtctgtgaggcctgaatcactcctgcccaggtgctcagctgcacctggaagcagcgtctccctctagcagtaaccagcaaagcaacagctgccgtgagccagaaatttagacccttagttgagatctgacctttcacctcaacagaacctctgcttatttatctgatggttcctgacctcaaacaactgagtcttgagctcagcaaaatgacaaactgtctttctgtttactcctcagttccaaagtctaacattggtatttgtttttagaattgctttgctaagtattcttaatgagtccagaggtgttcagttaaaccaactttgggattaagaataaatgttctgaaacgtggactgtaagtaggctgaccgttgatcattgttggctggataaggaacttgatggttttttaaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctacttaaaataaaaaattttttttaaaaaagcaaaaaatttagccaggcgtggtggcgggaatctgtaaccccagctacttgggaggccgaggcaccagaatcacttgaacccaggaggcagaggttgcagtgagcccacattgtgccactgtgctccagcctgggcgacagagtgagactctgtctccaaaaaaagaaaaaaaatagtgcattttgggttttaaaactaaaattgggacgtgtttcctcataatgagaggtggtcatcaagtatgagtcccaatgtgagtttgtccccagagatgccatctgtcttgtagcagagtttattttcatggtgtcccagaatatttttgtctgatttttaaaatctctccagccctgagagtgggcccatcagaccagccatgtggttggtacttccgctggtatgaaagagccccaccgccttggggaattcacccctcccaggctctcccactcagaggctctgccctgatcggccaccccaagggagggagaggtgggaagattagcctacctgttcccttctctactgcaggggctgcaggaagaggggctggacttgggggcacagatggaggctgcaaggcctctggtccaggagaaccccaaccaccagcacaaaatggaccagctttcctccgacttccaggccctgcagaggtctctggaggtaaggggctggcagaagggcctgtgctttgacagagagccggcccctgtcatccaacacgcctggggcctttcttcccctttcctgccttcattccttctaacctctcttttttctttctccctgttttcttcccttcctcattcatacaacagacaattattgagcacctcccatatgccaggcagtgttctaggtggccctaaggatggaggtagcagagcatgacagcccaggcccctgctctcctgggagttacgccccagttgggtagatggacaattaatcatcaagcaaacaagccaatgcacaattacatattgagattagggccaagcggcaaaagaagagagcaggctgctgagatccttaggcagcccagaacacaggcggcctcgggtcccttgcagcctgcacaaggcctggaggccacagagcttcatcgccagtgccctctagtggccacctcagctctttctagggtttgtccaggattcagtccccttccagcagtagggatggaactcaaagctccttcaaaactggcctgaggacaagtggaaatgcagactccaggccccactgtgacactgattcagatggagtcctgggtctgccgttgtaacaagccctgaggagtataaagcagggtctctggtgctcacacctcaagaaaacccagtgaggcagtgagagctctccctcctacctgacattgcacgccctatttcataccaaacattcctaacctcctctttacactcctgaaattcatagggaatatacccacccaggaaatagaaaagagaaatcaaaggaaagtaattataatacaatattgtccaatatgtaagtactcccagatggccacactcaagacataaggaggtggtcagaacgtgccctccctgtgtgacagccgcaaatgctgtgtcaggtggcacaaccatcacggcctctagtgatgtggttttctgaaatgggaacaacgcttgatagcactttgatcaaacccaagagcagtcttccatccacttacacaaagggtgcagctctagagaagtcagtatgtttgttaaaactgcaaaatcttccttgtgtttgtgtgttgattggagtgacagtctgagctcaggtcatgccaagcaggttttttactgctgtagatattaggaggacatgagaaaatcgtgtgggatgtgggcaaattctgcatttgtggactatccaccccagggtggaatgcgagcacccatccctctcactccacctagtatcaccctcaccacctctatcgcagcaactgcaaaccctccccaccagtttccaggacataaggcatcacctgtggagccccattggtgtaagtgacgattaatgtctggttgaattcatttaattacattcaataaactagcagttagtagtttcaaggtcgaggcagtagagaaataggacacactgtcctcactcctcaggagcccatagaaacccgtagaagcagcaaaagtctcctaatacctccatccaaatgatgggctagattagtcgttacgagaagcagcgttaactgagcatcactcggtgttgcaaaatgatgatattccaattcttattgattgtttatattcttctttaaagagaaattgcccttttattattttggtacccagtgcttgttaatctaatatgtccttccccacagcgaggcagtctctgtgtccccctggggggcaggtatctgatgttggagatcacagctctatgtacgggaagcccttggaggcgtctggtctaatgttggcacacagggaccaggaggggacagtggtagggacaactcagagaagtggagttttagataacttctcaggccctcattgatggctcactgaggacagaggcagcagtctccccagcccctggtatgggcctggtatccagcgatctcagtcagtgtctgtggaatgtagaaggcagggcctatggtagccctgcagagagtcatgatgaccttattcaaggaacacagctggaatgggaacggcaggccctggggtctgactggttcatggcaggctatgtaaagaaagctccaagggtctcaggctgggtggccagaggcatagagaatggctgcccttctggggacagtgtccacctttcctggtgacagagagctgaacaatagattggcccaggaaacagtactcaggaaaaagaacaaagaaagactgaacgtgaatatctgagtgtgcagctcgattactttttttaaaaattaaatgcatctgtgttaccagcacccaactaaaacacagaatattaccagcctcccaaagcctctgtgcctgcggtcatgcccagctcaccattcccgaccctcaaggggggctctgacttcatgcttcccgcaacatagcttgggcttgcctgatgttatccttcatttaaattgaattggacagaatgttttcttttgtgcctggcctttagctctccagatgatggttgtaaattcatctgctgtattgcatgtggttatagactgttcattcttgctgctgtaaaacattccattgtgtgaatataccaccgtgtatttattcattctactcttgatgggcacttggatagtttccaacttggggctgtcacatgtatgaccttgggtgaggatatgttcccatttctgggacatacaccgggagtggaatggctgggccatcagctacagccacgttccatttgggtagattctgacccgtggtttccacaagtggttgagccaatttacacttggatcagtggtggacaggagatccaatttcccccaccctcacctagacttggtcgttttcctaaaagtaagataggctttaaaccagatttgatcttccaagggtaaattccttgtgctgtgtggagggaagggccagcccagcctcttgtggtgctacttggtggggagccctggggtccccagcgggtgtgagagccctgcagggtgggggtggtgcgggggtctccccctcggccagcactcaggatgccctgggctccccgggctgtgctgcaggaccttgtggacaggtgtcggcagagtgtgcaggagcactgcaccttcagccaccagctgctggagctgcggcagtggatcgttgtg

SEQ ID NO: 14729 - DNA, 5485 bp, Homo sapiens; identical to SEQ ID NO: 14728

SEQ ID NO: 14730 - DNA, 280 bp, Homo sapiens
tcacgcctgtaatcccagcactttgggaggccgaggtgggcggatcacgaggtcaggagatcgagaccatcctggctaacacagtgaaaccccgtctctactaaaaaaatacaaaaaaattagccgggtgtggtggtgggcgcctgtagtcccagctactcgggaggctgaggcaggagaatggcgtgaacccaggaggtgaagcttgcagtgagctgagatcgtgccactgcactccagcctgggcaacagagtgagactccagctcaaaaaaaaaaaa

SEQ ID NO: 14731 - DNA, 1342 bp, Homo sapiens
caaacttcagtggggggcactgactcgtgacccgtggttccccaattctattacttttcccatgtcctggtgggtccccaccacatctctgcattgactgggctgagtttgtcttctcagcctcatcagaaactggcatctgcagaggatggaagtggattcggggaagaaaatggttttcaccaacaacatcccaaagtcaggatttctcatcaatcccatggatcctattcccaggcatcgtcgacgcgtgagtctgtctagcagggctgtgggagaaggggccaggccccaggtcaagaggtgggtaggggtctccagcacaggcccctccctgtctggggcaacatgctctgctctgaggacttggccacgtcctgtctcatttgagcctgccccagctgtggccaaagagcatttgatcctactccacagaggacctcagagatcccagagtctgcagagccaggccaccagggcagtaggggtatcccttagccagtcagatactcacctctgtgagccactagcagcagctcctgcagggaagagagtgtcggggctgaaagcttcctgctggccccagattggaaaccgaaaccatacaagatgggaaaacttttctgccatgtttcatccatcccttactgcctctaaacaaacttgagctttgtggaaaagaaagttattccttgttattcaaatacatcaaattattcattttcccattcattctttcatccactcctccatttgctgagtgctactttgttccaagaactgtgctcagagctaggatacagccgtgagtaacgcttctgaccctcagagaatttggaatccggcatagagcttttcagtgggcacacagccttgtattaaaatgcaggttctgggctgggtatggtgagctacacctacaatctcagaactttgggaggctgggaggccaaggcaggaggattgcttgaggtcaggagtttgagacaagcctgggcaagatagcaagaccccatttctataaaaaatatttaaaaattaactggacatggtggtgtgctcctgtagttccagctactcaggggcctgaggtgggaggatcacttgagcccaggagtttgaggctgcagggagctgtgattgtgccactgcactccagcctggtgacaaagcaagaccccatttcaatcaatcaatcaatcaacaaaaaataatgaaataagataaaatgcagactctgagttagtagatctggctagggcccacaattcgattctgcatttctaacaagctctcgggataggcccatgctgctgggcccgggagatactcacctctgtga

SEQ ID NO: 14732 - DNA, 1342 bp, Homo sapiens; identical to SEQ ID NO: 14731

SEQ ID NO: 14733 - DNA, 303 bp, Homo sapiens
ggctgggcacggtggctcacgcctgtaatcccagcactttgggaggccgaggtgggcggatcacgaggtcaggagatcgagaccatcctggctaacacagtgaaaccccgtctctactaaaaaaatacaaaaaaattagccgggtgtggtggtgggcgcctgtagtcccagctactcgggaggctgaggcaggagaatggcgtgaacccaggaggtgaagcttgcagtgagctgagatcgtgccactgcactccagcctgggcaacagagtgagactccagctcaaaaaaaaaaaaaaaagaa

SEQ ID NO: 14734 - DNA, 1377 bp, Homo sapiens
gtatatcttgtctgtcagctaaattgtgtccttaagggcaggacctgtgtttcagacatctttgatatttaccatgtttgtcataaatttagtgaatgtacagtatattttggttttaggcgagcagtgtatctgtcccttttgctgcttgctagttctgccttacaacttccactggaaagagctttttagtgcagcaaatagtgtctgcattttattgtataaagcattgcctgggccataccaaatcattttgacagaggtcatttcagggatgccacaggcttcataattgctacttgatgctagttgtagcaaattgcacttgggttttggtagttgtgagtatagtgttgtctccttccaccccgccttgtgtgttaatcactgactgccaggaaatctctttgacataacatcctaaaaagtttttgttatcagtagggccctgtaacatttttttccttttctaaagcctatgccttcaagttttttacaagtgtcttattccttctaaattgagaactaattgaatattttttcttgtagataaatcttattttaaatatctagttatcattactttgcattctccttttctgattttatgttacattaccaatatcttatgatatttaaacttttttgaactctgctttttaaaataaataatataaatgcctcaattatctggaacttacactgaaacactgtaatcttgtctctgagcctgcttcccctcaaaaaatttagatttagcttttcagatgcttatagctagccaagtaagtgagaataaacacaaaaaggctaaaatatgcaagttccggagttgtcaaagcttcatgtaaaatgtgtcattgtggaatttaaaaaattctacgctttttcatcaaggtttttggttggggcattagacacttcctgaaatctggcattctcctaggcactggggataccatggagaagaggcagatatggtcttggctcacatggggcatataatcaagcagtaattcttaaccttggacagacttgagtccattatgccaatggtcatctccactttgccatgccattttagttttccctaagtaaaaactacgcctgtaatcctagcactttgggaggccaaggcgggtggatcacctgaggtcaggagttcgagaccagcctggccaacatggtgaaacctcatctctactaaaaatacaaacattagctgggcgtgatggcgcgtgcctgtaatcccagctactcaggaggctgaggcaggagaatcacttgaacttgagagacggaggttgcggtgagccgagatcaagccactgcactccagtctgggtgatagagtgagactcagtctcaaaaaaaaaa

SEQ ID NO: 14735 - DNA, 38771 bp, Homo sapiens; identical to SEQ ID NO: 6652
  misc_feature (7892)..(9416): n equals a,t,g, or c

SEQ ID NO: 14736 - DNA, 1390 bp, Homo sapiens
gtatatcttgtctgtcagctaaattgtgtccttaagggcaggacctgtgtttcagacatctttgatatttaccatgtttgtcataaatttagtgaatgtacagtatattttggttttaggcgagcagtgtatctgtcccttttgctgcttgctagttctgccttacaacttccactggaaagagctttttagtgcagcaaatagtgtctgcattttattgtataaagcattgcctgggccataccaaatcattttgacagaggtcatttcagggatgccacaggcttcataattgctacttgatgctagttgtagcaaattgcacttgggttttggtagttgtgagtatagtgttgtctccttccaccccgccttgtgtgttaatcactgactgccaggaaatctctttgacataacatcctaaaaagtttttgttatcagtagggccctgtaacatttttttccttttctaaagcctatgccttcaagttttttacaagtgtcttattccttctaaattgagaactaattgaatattttttcttgtagataaatcttattttaaatatctagttatcattactttgcattctccttttctgattttatgttacattaccaatatcttatgatatttaaacttttttgaactctgctttttaaaataaataatataaatgcctcaattatctggaacttacactgaaacactgtaatcttgtctctgagcctgcttcccctcaaaaaatttagatttagcttttcagatgcttatagctagccaagtaagtgagaataaacacaaaaaggctaaaatatgcaagttccggagttgtcaaagcttcatgtaaaatgtgtcattgtggaatttaaaaaattctacgctttttcatcaaggtttttggttggggcattagacacttcctgaaatctggcattctcctaggcactggggataccatggagaagaggcagatatggtcttggctcacatggggcatataatcaagcagtaattcttaaccttggacagacttgagtccattatgccaatggtcatctccactttgccatgccattttagttttccctaagtaaaaactacgcctgtaatcctagcactttgggaggccaaggcgggtggatcacctgaggtcaggagttcgagaccagcctggccaacatggtgaaacctcatctctactaaaaatacaaacattagctgggcgtgatggcgcgtgcctgtaatcccagctactcaggaggctgaggcaggagaatcacttgaacttgagagacggaggttgcggtgagccgagatcaagccactgcactccagtctgggtgatagagtgagactcagtctcaaaaaaaaaaaaaaaaaaaacaa

SEQ ID NO: 14737 - DNA, 248 bp, Homo sapiens
cgagttttgtattgtcattcttgaataagccacaattgtgtgtgtgtgtgcgtgcgtgtgtattttcgggacgaaattgttccacctcacatcatcaggcgttagattcttgggagtgccgcacaacctagatccttcgcatgggctgttcacagtaggatccgtgctcctatgagaatcagcgttgcctctgatctgacaggaagcggagctcagcgggtaatgctggcttgcctgctgctcacctc

SEQ ID NO: 14738 - DNA, 1155 bp, Homo sapiens
tagagtgtacttacacaaccctagatggtatagcctgctacatacctaggctatatggcatagcctattgctcctaggctgcaaacctgtatagcatgttactatatggaatactgtaggcagatgtaacacaagacgaatatttgtgtatctaaacatatccaagccataaacgtagagaaggtacagccaaattatggtataaccttatggttatagttatgggaccaccatcatgtatatatggttaatcattgactgaagtgtcattgttcaacacatgcctgtactctttctaaaccaaaatagtgtcatcttgctttgtacataaatcatacctgctttttttgtcattgctcaaaaggtttattctggaatgtccttcgaccaccttgtagatttatatattctttattcaaatttagctcaagtcccatttccaacactaagatatttggataccctcagctttcattgatgtttcttttttagtacttgttttgtcatttggcaattagggtgtgctaccttgtactgttttttacttgcttcttataaatctgttcagtcaatttaacaaatatttattgagcgtctactacatgcaagtaactgttctaggaattagggatatagcagtcaacagcacagacaatctctcatctctttggcaacttcctctgtacctttaaagacaaatatctccaacacctatcacggtatatgttgttaatgatgttaaaattgtgtccaaattaacagaaggccaaatttaacattgaagtccaaatttcttggctaataatgcaagtaaaaaaaatagatgataccttttggctgatctgaatacactgataactggctggacgcggtggatcatgcctgtaatcccagcactttgagaggccgaggcgggcggatcacctgaggtcaggagttggagaccagcctggccaacatggtgaaacccgtctctactaaagtacaaaaattagctaggtgtggtggcacatgcctgtaatcccagctactcaggtggctgaggcaggagaatcacttgaacctgggaggcggaggttgcagtgagcccagatcacatcactttactccagcctgggcgacagagtgagactctgtcacaaaaaaaaaaaaaaa

SEQ ID NO: 14739 - DNA, 5775 bp, Homo sapiens; identical to SEQ ID NO: 6656

SEQ ID NO: 14740 - DNA, 738 bp, Homo sapiens; identical to SEQ ID NO: 6657

SEQ ID NO: 14741 - DNA, 1155 bp, Homo sapiens
  misc_feature (1139)..(1139): n equals a,t,g, or c
  misc_feature (1142)..(1142): n equals a,t,g, or c
tagagtgtacttacacaaccctagatggtatagcctgctacatacctaggctatatggcatagcctattgctcctaggctgcaaacctgtatagcatgttactatatggaatactgtaggcagatgtaacacaagacgaatatttgtgtatctaaacatatccaagccataaacgtagagaaggtacagccaaattatggtataaccttatggttatagttatgggaccaccatcatgtatatatggttaatcattgactgaagtgtcattgttcaacacatgcctgtactctttctaaaccaaaatagtgtcatcttgctttgtacataaatcatacctgctttttttgtcattgctcaaaaggtttattctggaatgtccttcgaccaccttgtagatttatatattctttattcaaatttagctcaagtcccatttccaacactaagatatttggataccctcagctttcattgatgtttcttttttagtacttgttttgtcatttggcaattagggtgtgctaccttgtactgttttttacttgcttcttataaatctgttcagtcaatttaacaaatatttattgagcgtctactacatgcaagtaactgttctaggaattagggatatagcagtcaacagcacagacaatctctcatctctttggcaacttcctctgtacctttaaagacaaatatctccaacacctatcacggtatatgttgttaatgatgttaaaattgtgtccaaattaacagaaggccaaatttaacattgaagtccaaatttcttggctaataatgcaagtaaaaaaaatagatgataccttttggctgatctgaatacactgataactggctggacgcggtggatcatgcctgtaatcccagcactttgagaggccgaggcgggcggatcacctgaggtcaggagttggagaccagcctggccaacatggtgaaacccgtctctactaaagtacaaaaattagctaggtgtggtggcacatgcctgtaatcccagctactcaggtggctgaggcaggagaatcacttgaacctgggaggcggaggttgcagtgagcccagatcacatcactttactccagcctgggcgacagagtgagactctgtcncanaaaaaaaaaaaaa

SEQ ID NO: 14742 - DNA, 248 bp, Homo sapiens; identical to SEQ ID NO: 14737

SEQ ID NO: 14743 - DNA, 1443 bp, Homo sapiens
cccaagctcccttggactctgtatgttccaactgcatactgtgcttatgctaatgaatttcgttgttgccttgtctgtccctctgactttgaagacagaggcagtgagtacagatgtttgacacagtgcccagtacatatatgatcttaatatttgttgactattaacatcgttgttattgttaataattatagaatgtactgttaactttttttaactttttaaaaaatcttgttttttatagcctcaaggaataggttctcctagtgtctatcatgcagttatcgtcatctttttggagttttttgcttggggactattgacagcacccaccttggtggtaagtaatcttttaaattatttaacactgactccaaaatctcttcttcttcagttttggaggaaaatgtgggccttttccctttgcacggttaattctcccaccagtattgttcagtattcaccagtattttactggttgtcttttccaactgttaactctcccttacctttttttgggaggggggtggcgtggaggtgtttgaatttggacttgtcactgggcatgttcaagcagaggctctgtaactactctgagtaaaatggaagagattcttaaaccgacaggtttagaaaagatgatgtctgtgacctgcatgactcggcataattactttgaggttcatttatgcagctgtactttccaaaaacaggtttctgttcatttgggctaagtacctagaagggctattctttaatagatctaagctgattttacccaaattctcccaggtttgaaactttagaaaagacctccctgcccgaccaaacaactcagaagatagccagttttcttatattggtgtagataaggggaatggaaggagggaaggactatctatggtaaatatctataccatcttgaaaggagtaattatgataaatgtacagtttaccaaatcctagaggaatagagttttaaagtaatatactatgttttcatgaaggtttttataaaaaagttatttaatagaaaaattatgtaagtagattgaactagcctaagaacatttacagtacatatttcttgatatatttattgacagctgtgtaattgttactatctatacataaaatattgatgtttagcagttgcttatgcctgtaatcccagcattttgggaggctgggtgggcagatcgcttgagctctggagttgagaccagcctgggcaacatggtaaaaccttgtctctacaaaaaatgcaaaaattagttgtgcatggtggcatatgtttgtagtcccagctactcgggaggctaaggcaggagaatcacttgagcccaggaggcagaggttgtagtgacccgatatcgtgccaccacactccagcctgggcgacgggagtgaaaccttgtctcaaaaaaaaaaaacaaaaaaaaa

SEQ ID NO: 14744 - DNA, 1443 bp, Homo sapiens
cccaagctcccttggactctgtatgttccaactgcatactgtgcttatgctaatgaatttcgttgttgccttgtctgtccctctgactttgaagacagaggcagtgagtacagatgtttgacacagtgcccagtacatatatgatcttaatatttgttgactattaacatcgttgttattgttaataattatagaatgtactgtttactttttttaactttttaaaaaatcttgttttttatagcctcaaggaataggttctcctagtgtctatcatgcagttatcgtcatctttttggagttttttgcttggggactattgacagcacccaccttggtggtaagtaatcttttaaattatttaacactgactccaaaatctcttcttcttcagttttggaggaaaatgtgggccttttccctttgcacggttaattctcccaccagtattgttcagtattcaccagtattttactggttgtcttttccaactgttaactctcccttacctttttttgggaggggggtggcgtggaggtgtttgaatttggacttgtcactgggcatgttcaagcagaggctctgtaactactctgagtaaaatggaagagattcttaaaccgacaggtttagaaaagatgatgtctgtgacctgcatgactcggcataattactttgaggttcatttatgcagctgtattttccaaaaacaggtttctgttcatttgggctaagtacctagaagggctattctttaatagatctaagctgattttacccaaattctcccaggtttgaaactttagaaaagacctccctgcccgaccaaacaactcagaagatagccagttttcttatattggtgtagataaggggaatggaaggagggaaggactatctatggtaaatatctataccatcttgaaaggagtaattatgataaatgtacagtttaccaaatcctagaggaatagagttttaaagtaatatactatgttttcatgaaggtttttataaaaaagttatttaatagaaaaattatgtaagtagattgaactagcctaagaacatttacagtacatatttcttgatatatttattgacagctgtgtaattgttactatctatacataaaatattgatgtttagcagttgcttatgcctgtaatcccagcattttgggaggctgggtgggcagatcgcttgagctctggagttgagaccagcctgggcaacatggtaaaaccttgtctctacaaaaaatgcaaaaattagttgtgcatggtggcatatgtttgtagtcccagctactcgggaggctaaggcaggagaatcacttgagcccaggaggcagaggttgtagtgacccgatatcgtgccaccacactccagcctgggcgacgggagtgaaaccttgtctcaaaaaaaaaaaacaaaaaaaaa

SEQ ID NO: 14745 - DNA, 465 bp, Homo sapiens
aaactgctccattgtcatatgtgacactgtattctcttcactctcctgatattttcttactgttccttttatcttcctcttttctttatcaaagaagaaaaaccttcactattttcctgtgcctcctacttaaaatgttggcgcttcttggggttctgtctcagcccactgctgttttcacacttgacactcctgataatctcatctactctggtggtttcagatatcacatttgctgctaattgttttaatcagtgctcaaagacaatacaaatgtttcaagtaaagagggcagttttgtagataggacctgaagtaaatctgagcctcgtggggggaagtgctgggaagccaccagctttaactgctagacaaccaagctaaacacttggaagttgttcttgattctcccttccgctatttatcaagctcctcccaatttcaaatcctgaatccttaatccgt

SEQ ID NO: 14746 - DNA, 465 bp, Homo sapiens; identical to SEQ ID NO: 14745

SEQ ID NO: 14747 - DNA, 1999 bp, Homo sapiens
ccgccttaactttaaattcagatacttttaattctttggttatggtttgttggttgctaccactgtgggtcactgtcttatccttcccagtagggatagatgtggctgctcttctgattttcacctcctcttactaatttaccctgtggtgggaaacacatcaactgatagtgttatttcatgttaagtaaaggcaaatagccaccttcctcatttgactgaaactcaatgtgtcacattctacctcttttcttagtccttaaggatttctgtcatctgttagtctgcaggctcttaaggtcaggctctgtcttcccttcatctttgaagcttctactcttgtgcttccctcttgatgtaggccctgaatcactgttttgttgactaggagagcacatgaactgtttgtgcaacctctcaagctccgtttgaaatggaagatgatcatacatcttgtggcacccctttttcccagatcccaagcttccgggcaccctttctttcttcacctccacagatgctgccttcacccaccctttgatgaaccatcttgatcaactgccaagaatgtcaagggcatttctaacgccagggcaacagctatgagcacttatgagaccacatcaggtttgactcctgaacgaaggatgtccttatccatggtctctttttcctggcaggcatcttgctgttattttggaaattttctctgggccgtagaggtttgaaccagtcatgtctaggagcgtttgttttctcaggaaaagcaaccctgttaaagccattgttttaaaaagtcacttggagcattaaaaacctttgaccatccattcatagtgctaaaatttaggagtggggcttcaggcaagcaatattgaattaaatgtgtggagcactttaagacagcatttgattgtacatttaaaatagggaatgcaaattgaaattcctcctgggtgctttaaatcatgcattatatgtgcagtattttcaattagctgcagaaaaaaatatgttcggtgtggctgtatttttacagctgggaattgctcagagaacacaattgactatttcatccatgtgagatttatttaaatgactcgtggggcatttgcagtttagccaataattgaaaatattgttgcaatgtggcaggtaaaactaggaaatcatttcgcattcctgcagaggtgttccaagctcagcagcatattatattagttgaagaggggcaaacggagtgagatcagtgttgagtcctagtctttcacatttcattcctgggttttgccccaccatggaaatatatgggatggtgctttccagaaggacctgaaacgctaaggtgttatcttgtttctattctgtttttatatgccaaacacaaatgaatggtcagaccagatatggaaagacccatctatcccccaactctcttctgactcctatacctttctttctattcttcgtaccatttcacttcagacgtcacctggaatactgatgcaggaggctaagctgagtctctcagggtagacagttcaacctttccatggttgttcataaatattactagggatttggaatgcatgttcccactaaaatgatgtaaatgtggttaagtgataccatattaaaatgcatcattacttgtgtgattcagacaaagtatgggttaactaggcattttgaaggcagaattaaaatactaaccaccaccactttctctgtaatagtggttgccaaccaggggtgatccttcctctctccttcagggacatttgtcagtgtctccagacatttggttggtccatctgggtggggtgctattagcatctcttgagtaaaggccaggaatactgctaaacattctgcaatacacaggatagccccctacaatgaataattatccagacccacatggcaagagtgacaaggttgtgaaactttgctctagaaatgtgtacattctttttttttttttaaaaaaaaaaaaaaa

SEQ ID NO: 14748 - DNA, 1999 bp, Homo sapiens; identical to SEQ ID NO: 14747

SEQ ID NO: 14749 - DNA, 1919 bp, Homo sapiens
  misc_feature (735)..(735): n equals a,t,g, or c
tatccttcccagtagggatagatgtggctgctcttctgattttcacctcctcttactaatttaccctgtggtgggaaacacatcaactgatagtgttatttcatgttaagtaaaggcaaatagccaccttcctcatttgactgaaactcaatgtgtcacattctacctcttttcttagtccttaaggatttctgtcatctgttagtctgcaggctcttaaggtcaggctctgtcttcccttcatctttgaagcttctactcttgtgcttccctcttgatgtaggccctgaatcactgttttgttgactaggagagcacatgaactgtttgtgcaacctctcaagctccgtttgaaatggaagatgatcatacatcttgtggcacccctttttcccagatcccaagcttccgggcaccctttctttcttcacctccacagatgctgccttcacccaccctttgatgaaccatcttgatcaactgccaagaatgtcaagggcatttctaacgccagggcaacagctatgagcacttatgagaccacatcaggtttgactcctgaacgaaggatgtccttatccatggtctctttttcctggcaggcatcttgctgttattttggaaattttctctgggccgtagaggtttgaaccagtcatgtctaggagcgtttgttttctcaggaaaagcaaccctgttaaagcccatttgtttaaaagtcacttggagcattanaaacctttgaccatccattcatagtgctaaaatttaggagtggggctcaggcaagcaatattgaattaaatgtgtgagcactttaagacagcatttgattgtacatttaaaatagggaatgcaaattgaaattcctcctgggtgctttaaatcatgcattatatgtgcagtattttcaattagctgcagaaaaaaatatgttcggtgtggctgtatttttacagctgggaattgctcagagaacacaattgactatttcatccatgtgagatttatttaaatgactcgtggggcatttgcagtttagccaataattgaaaatattgttgcaatgtggcaggtaaaactaggaaatcatttcgcattcctgcagaggtgttccaagctcagcagcatattatattagttgaagaggggcaaacggagtgagatcagtgttgagtcctagtctttcacatttcattcctgggttttgccccaccatggaaatatatgggatggtgctttccagaaggacctgaaacgctaaggtgttatcttgtttctattctgtttttatatgccaaacacaaatgaatggtcagaccagatatggaaagacccatctatcccccaactctcttctgactcctatacctttctttctattcttcgtaccatttcacttcagacgtcacctggaatactgatgcaggaggctaagctgagtctctcagggtagacagttcaacctttccatggttgttcataaatattactagggatttggaatgcatgttcccactaaaatgatgtaaatgtggttaagtgataccatattaaaatgcatcattacttgtgtgattcagacaaagtatgggttaactaggcattttgaaggcagaattaaaatactaaccaccaccactttctctgtaatagtggttgccaaccaggggtgatccttcctctctccttcagggacatttgtcagtgtctccagacatttggttggtccatctgggtggggtgctattagcatctcttgagtaaaggccaggaatactgctaaacattctgcaatacacaggatagccccctacaatgaataattatccagacccacatggcaagagtgacaaggttgtgaaactttgctctagaaatgtgtacattctttttttttttttaaaaaaaaaaaaaaa

SEQ ID NO: 14750 - DNA, 1999 bp, Homo sapiens; identical to SEQ ID NO: 14747

SEQ ID NO: 14751 - DNA, 320 bp, Homo sapiens
acacctggctaattttttttttttttttttttttttgagaaggagtctcgctctgttgcccaggctggagtgcagtggtgtgatctcagctcactgcaagctccgcctcctgggttcatgccattctcctgtctcagcctcccaagtagctgggactacaggcgcccgccaccatgcccggctaattttttgtatttttagtagagacagggtttcaccgtgttagccaggatggtctcgatctcctaacctcatgatctgcccgcctcggcctcccaaagtgctgggattacaggcgtgagccaccacgcccagcctaa

SEQ ID NO: 14752 - DNA, 320 bp, Homo sapiens; identical to SEQ ID NO: 14751

SEQ ID NO: 14753 - DNA, 320 bp, Homo sapiens; identical to SEQ ID NO: 14751

SEQ ID NO: 14754 - DNA, 2024 bp, Homo sapiens
tttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttatttttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgttttttaagctggggaccactgaagtaagctctgtatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaaataaaaggatatcctggggcctcaaaatgtagaacacctttagaccatttataactgttcctagaactgttgagaatcatgttctttagtaaatgatctgtggtttacacttaagatggctagaagcttagttacagggtacatagaaatacatagatcaagtaaaactccaactactgtagctggaatttgtaaactaagtttgtaagacctcttttatttcctatggagttattctttaatttacagtttattctgtaagttgggaagtaaaatagagaaaataataaatctagatgttctcagtgtcttattcaggaactttttatccctcctcactaaggaattcccactgtgactttaaaatagaactaaattacttgtgtgcatgtatatgtctgtattttttacacacatgcaaaaatatacattgggggcacgtgtgtgagagatatgaatgtgtgcttatataaaaatagataaaggtaaccgaatgtattgtagaaacatgatttatttagttgagggtattggagttactttctcattgtctctgttgtataaatacaccaaattaatcattatgttatcttatgttaaaaggctagctct

SEQ ID NO: 14755 - DNA, 2024 bp, Homo sapiens
tttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttatttttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgttttttaagctggggaccactgaagtaagctctatatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaaataaaaggatatcctggggcctcaaaatgtagaacacctttagaccatttataactgttcctagaactgttgagaatcatgttctttagtaaatgatctgtggtttacacttaagatggctagaagcttagttacagggtacatagaaatacatagatcaagtaaaactccaactactgtagctggaatttgtaaactaagtttgtaagacctcttttatttcctatggagttattctttaatttacagtttattctgtaagttgggaagtaaaatagagaaaataataaatctagatgttctcagtgtcttattcaggaactttttatccctcctcactaaggaattcccactgtgactttaaaatagaactaaattacttgtgtgcatgtatatgtctgtattttttacacacatgcaaaaatatacattgggggcacgtgtgtgagagatatgaatgtgtgcttatataaaaatagataaaggtaaccgaatgtattgtagaaacatgatttatttagttgagggtattggagttactttctcattgtctctgttgtataaatacaccaaattaatcattatgttatcttatgttaaaaggctagctct

SEQ ID NO: 14756 - DNA, 3676 bp, Homo sapiens
atttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttcttttttttttttttttgcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagta

SEQ ID NO: 14757 - DNA, 222 bp, Homo sapiens
tttgcagtaagttgcacattttattgtttgcaattttctgttttatgtgcatttaaaagcccttctctgctttctagtaaggaggcatgaaattatcaggaatgttgctagttacagcttcacaccaaaaactttgagtaaatacattttcgtttggatgcccatgatgaaagctgaggaaagtggttgaggaattatcaacaacaaacttttcctcttatt

SEQ ID NO: 14758 - DNA, 222 bp, Homo sapiens; identical to SEQ ID NO: 14757

SEQ ID NO: 14759 - DNA, 1536 bp, Homo sapiens
atttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctca

SEQ ID NO: 14760 - DNA, 2200 bp, Homo sapiens
ggaccacttgaagtcattgaagggaactctctggagatagtggagttcttagtctctgccctttgttcttaaaatattcagctgcattttaggtaaggtagtgatctgccttcaattgcaaatagttgataatatcacttttaatgtagactaaagccaacatttttcatgtattgttctatttggagtaaataacacattttggcatggttcttcatgtcttagcatctgtcagttttcatgtgaggactcagtttacaggttatatacagcacatgttgagcgtggtcagtgggtatttgtacctgaagtacgtacttcccttctgttgctgatattgtcatgagcagttccaccctcagtgtttacctctatgctttgaaatcttctctcaaacgcatattcattcctattttttgtaccctttgggattcctcaatctcatatacatctttccatttctgacctaatcccagcactttgggaggctgagccgagcatagtggggtgtgcctatagtcccagctactcaggaggctgaggtgggaagatcacctgagcccgggagctggaggtttcagtgagctcagatgtgccactgcattccagcctgggctacagagcgaggccctgtctcaaaaaaaaaagtctcatgacttcgtctcctagatgagaccatctctagctgatgcctttgcttgcattctcatgtgcagggccagcagatactgatggagcagatgttctctgaggctgtaggtgctggggcacagatcttttcctcatcctactacctagtgaaggggagaaatgacaagcgaggcaactgcaggtgaaaagtgtttggagagaggtttctatagggctccagtctatgcactgagcccaggcatagacttcagagatgcttcctgaaaagaagttggcaagatatgagggaggagggcgcagctcctgattcctctgacctttctattgtgggtttgatgccccctccccacctgagtcctcatgggcagctgtgttttgtttttttttgttttgttttgttttgtttgagacagagtctcgcactgtcgcccaagctggagtgcagtggtgcgatctcagcagctgtgtttttaagaagtgtttctactcctttccttactcaatcctgaccctgtaaaattcccacttgctggctgccccctccccaaggaaaggccgcccctctgcccctccacagtgggtggtgcccagagtcaggggacaggtctgggctttcctattcttgctgacccagctatagagaccgtgctctttcccattcagagagtcatagctacttggtttttttttgtttgttttgttttgttttgttttgttttgtttgtgtgtgtgtcttttattttacgcttggggttgtctttttaaaactttcttttattcttttatcttgggataattacttattttaaagtaagccttgtttgtttttgtctgttaaaaatctttacagccatccagcttatatcaacttttttatttcctgccaggcaaaaagaattaatagaaaatggcagcccaagaggtaagatacgcagtctgtccacaccccaaacagggcaggataaatgcctttcttggttctaataagccctgaagagatactccctgtagcaccaagtcatttccctctgctgcccctttgaggtgactgtattcccaaaagtagtcagtgtagaggaatggatggcccgtttaggataggtagttgcacagattatctctgagggaggtgactaagaagctgaactccaaagacaagacaaaggaattgatgaacagtatcattctcttaactctgggatagggattctgtgaaggttaatgtatgctcttttttctagggagaagatccctttatatttgattgtcatggggatctgtggcccagagtaaaatcagcagtcccagctgtatagactttcaggttcattatggttgtgatctgaaaaccttggtcacctctgtggtatgtgtcattggattctagctacttgagtgaagtggctcctgtgcattcttagaagcgagtatgagagaggatggggtggagttccagttttactagagaaagctctcaaaagagaattttgatacccaacttgaaacctggaaaattaccaagtacagcttcgtgttaaaaaaaaaaaaa

SEQ ID NO: 14761 - DNA, 2200 bp, Homo sapiens
ggaccacttgaagtcattgaagggaactctctggagatagtggagttcttagtctctgccctttgttcttaaaatattcagctgcattttaggtaaggtagtgatctgccttcaattgcaaatagttgataatatcacttttaatgtagactaaagccaacatttttcatgtattgttctatttggagtaaataacacattttggcatggttcttcatgtcttagcatctgtcagttttcatgtgaggactcagtttacaggttatatacagcacatgttgagcgtggtcagtgggtatttgtacctgaagtacgtacttcccttctgttgctgatattgtcatgagcagttccaccctcagtgtttacctctatgctttgaaatcttctctcaaacgcatattcattcctattttttgtaccctttgggattcctcaatctcatatacatctttccatttctgacctaatcccagcactttgggaggctgagccgagcatagtggggtgtgcctatagtcccagctactcaggaggctgaggtgggaagatcacctgagcccgggagctggaggtttcagtgagctcagatgtgccactgcattccagcctgggctacagagcgaggccctgtctcaaaaaaaaaagtctcatgacttcgtctcctagatgagaccatctctagctgatgcctttgcttgcattctcatgtgcagggccagcagatactgatggagcagatgttctctgaggctgtaggtgctggggcacagatcttttcctcatcctactacctagtgaaggggagaaatgacaagcgaggcaactgcaggtgaaaagtgtttggagagaggtttctatagggctccagtctatgcactgagcccaggcatagacttcagagatgcttcctgaaaagaagttggcaagatatgagggaggagggcgcagctcctgattcctctgacctttctattgtgggtttgatgccccctccccacctgagtcctcatgggcagctgtgtgttgtgtttttttgtgttgtgttgttttgtgtgagacagagtctcgcactgtcgcccaagctggagtgcagtggtgcgatctcagcagctgtgtttttaagaagtgtgtctactcctttccttactcaatcctgaccctgtaaaattcccacttgctggctgccccctccccaaggaaaggccgcccctgtgcccctccacagtgggtggtgcccagagtcaggggacaggtctgggctttcctattcttgctgacccagctatagagaccgtgctctttcccattcagagagtcatagctacgtggtttttttttgtgtgttgtgttgtgttgtgttgtgttgtgtgtgtgtgtgtgtcttttattttacgcttggggttgtctttttaaaactttcttttattcttttatcttgggataattacttattttaaagtaagccttgtttgtttttgtctgttaaaaatctttacagccatccagcttatatcaacttttttatttcctgccaggcaaaaagaattaatagaaaatggcagcccaagaggtaagatacgcagtctgtccacaccccaaacagggcaggataaatgcctttcttggttctaataagccctgaagagatactccctgtagcaccaagtcatttccctctgctgcccctttgaggtgactgtattcccaaaagtagtcagtgtagaggaatggatggcccgtttaggataggtagttgcacagattatctctgagggaggtgactaagaagctgaactccaaagacaagacaaaggaattgatgaacagtatcattctcttaactctgggatagggattctgtgaaggttaatgtatgctcttttttctagggagaagatccctttatatttgattgtcatggggatctgtggcccagagtaaaatcagcagtcccagctgtatagactttcaggttcattatggttgtgatctgaaaaccttggtcacctctgtggtatgtgtcattggattctagctacttgagtgaagtggctcctgtgcattcttagaagcgagtatgagagaggatggggtggagttccagttttactagagaaagctctcaaaagagaattttgatacccaacttgaaacctggaaaattaccaagtacagcttcgtgttaaaaaaaaaaaaa

SEQ ID NO: 14762 - DNA, 4302 bp, Homo sapiens
catccacaccaaaaccccatctatacatcatcatcatcaaagaccaaaggtagatacagccacaaagatggggaaaaaacagagcagaaaagctgaaaattctacaaatcagagcgcctgtccccctctaaaggaatgcagctcctcgccagcaacggaacaaagctggacagagaatgacgactttgacgagttgagagatgaaggcttcagatgatcaaacttctctgagctaaaggaagaagtttgaacccatcgcaaagcagctaaaaaccttgaaaaaagattagacgaatggctaactagaataaccagtgtagagaagtccttaaatgacctgattgagctgaaaaccacggcacaagaactatgtgacaaatgcacaagcttcagaagcctatttgatcaactgaaagaaaaggtatcagagactggagatcaaatgaatgaaatgaagcaacaaaagaagtttagagaaaaaagagcaaaaagaagcaaacaaagcctccaagaaatatgggactatgtgaaaagaccaaatctacgtctgattggtgtacctgaaagtgacggggagaatggaaccaacctggaaaacactctgcggatattatccaggagaacttccccaacctagtgaggcagaccaacattcaaattcaggaaatagagaacgccacaaagatactcctcgagaagagcaactccaagacacataattgtcacattcaccaaggttgaaatggaggaaaaaatgttaagagcacccagagagaaaggtcgggttacccacaaagggaagcccatcagactaacagcggatctctcggcagacactccgcaagccagaagagagtgggggccgatattcaacattcttaaagaaaagaattttcaacccagaatttcatatccagccaaactacgcttcataagtgaaggagaaataaaatcctttacagacaagcaaatgctgagagattttgtcaccaccaggcctgccctaaaagagctcctgaaggaagcactaaacgcggaaaggaacaactggtagcagccactgcaaaaacatgccaaattgtaaagaccatcaatgctaggaagaaactgcattaactaacgagcaaaataaccagctaacatcataatgacaggatcaaattcacatataacaatattaaccttaaatgtaaatgggctaaatgctccaattaaaagacacagactggcaaattggataaacagtgaagatccatcagtgtgctgtattcaggagacccatctgatgtgcagagacacacataggctcaaaacaaagggatggaggaagatctaccaagcaaatggaaaacaaaacaaaacaaaaagcaggggttgcaatcctagtctctcatgaaacagactttaaaccaacaaagatgaaaagagacaaagttggccattacataatggtgaagggatcaattcaacaagaagagctaactaacctaaatatatatgcacccagtacaggagcacccagactcataaagcaagtccttagagacctacaaagagacttagactcccacacaataataatgggagactttaacaccccactgtcaacattagacagatcaacgagacagaaagttaaaaaggatatccaggaattgaactcagctctgcacctagaggacctaatagacatctacagaactctccacccaaaatcaacagaatatacattcttcccagcaccacttcgtacttactccaaaattgaccacatagttggaagtaaagcactcctcagcaaatgtataagaacagaaattataacaaactgtctctcagaccacagtgcactcaaactagaactcaggattaagaaactcactcaaaaccactcaactacatggaaactgcacaacgtgctcctgaatgactactgggtacataacgaaatgaaggctgaaataaagatgttctttgaaaccaacgagaacaaagacacaacatgccagaatctctgggacacattcaaagcagtgtgtagagggaaatttatcgcactaaatgcccacaagagaaagcaggaaagatctaaaattgacaccctaacatcacaattaaaagaactagataagcaagagcgaacacattcaaaagctagcagaaggcaagaaataactaagatcagagcagaactgaagaagacagagacacaaaaaacccttcaaaaaatcaatgaatccacgagctggttttttgaaaggatcaacaaattgatagaccactagcaagacctaataagaaaagagagaagaatcagatagacacaataaaaaatgataaaggggatatcaccaccggtcccacagaaatgcaaactaccatcagagaatactataaacacctctacgcaaataaactagaaaatctagaagaaatggataaattcctggacacatacacccttccaagactaaaccaggaagaagttgaatgcctgaatagaccaataacaggctctgaaattgaggcaataattaatagcctaccaaccaaagaaagtccatgaccagaaggattcacagctgaattctaccagaggtacaaggaggagctggtaccattccttctgaaactattccaatcaacagaaaaagagggaatcctccttaacttattttatgagaccagtatcatcctgataccaaagcctggcagagacacacaaaaaaagacaattttagaccaatatccctgatgaacattgattcaaaaatcctcagtaaaatactggcaaaccgaatgcagcagcccatcaaaaagcttatccaccatgatcaagtgggcttcatcccggggatgcaaggcaggttcaacatacgcaaatcaataaatgtaatccagcatataaacggaaccaaagacaaaaaccacatgattatcttaatagatgcagaaaagacctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactcgcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtatatttagaaaaccccatcgtctcaccccaaaatctccttaagctgataagcaacttcagcaaagtctcaagatacaaaatcaatgtgcaaaaatcacaagcattcttatacaccaataacagacaaacagagagccaaatcatgagtgaactcccattcacagttgcttcaaaaagaataaaatacctgggaatccaacttacaagggatgtgaaggacctcttcaaggagaactacaaaccactgctcaatgaaataaaagaggacacaaacaaatggaagaacattccatcctcgtggataggaagaatcaatattgggaaaatggccatactgcccaaggtaatttatagattcagtgccatccccatcaagctaccaatgactttcttcacagaattggaaaaaaattctttaaagttcctatggaaccaaaaaagagccacattgccaagacaatcttaagccaaaagaacaaagctggaagcatcacactatttgactttaaactatactacaaggctacagtaaccaaaacagcatggtactggtaccaaaacagagatacagaccaatggaacagaacagagccgtcagaaataataccacacatctacaaccatctgatctttggcaaacctgacaaaaacaagcaatggggaaaggattccctatttaataaatggtgctgggaaaactggctagccatatgtagaaagctgaaactggatcccttccttacaccttatacaccaattaattcaagatggattaaagacttaaatgttagacctaaacccataaaaaccctagaagaaaacataggcaatcccattcaggacataggcatgggcaaggactccatgtctaacacacccaaagcaatggcaacaaaagccaaaattgacaaatggggtctaattaaactaaagagcttgtgcacagcaaaagaaactaccatcagagtgaacaggcaacctacagaatgggagaacatttttgcaatctactcatctgaaaaagggataatatcca

SEQ ID NO: 14763 - DNA, 530 bp, Homo sapiens
gtacaatctgggatcaagtgttctcgctgctctcagggatcggcgcacagcctgtgtgctcccatgtggcctgacttggatttcagagtttatatgaggcacagctgagagtctggaaaaggcacagcatcttctccttcctgtccagatgagccaagtgagcaggaagggtctcagcatctattcctgaggccctatgagaggtttcttcattcctttataatgattaagccctacattgggaatgggtttgatttgtcattgtacaaacttcagaggctttaatggtaattttattaaccttgctggaccttatggaatgttgataaaagcaaccactctttgttatgaaagcaaaaagagacattgaaaagttagttcaagataattggcaaagccagctgccatgatgagattgttgaatagtgatggtggtaatggcagaaaaggtgaaggctctttcttgaaagacagcacaggaatcaccgctctaatgctatctttgtgatgttactgttgaatatatgtga

SEQ ID NO: 14764 - DNA, 5176 bp, Homo sapiens
catccacaccaaaaccccatctatacatcatcatcatcaaagaccaaaggtagatacagccacaaagatggggaaaaaacagagcagaaaagctgaaaattctacaaatcagagcgcctgtccccctctaaaggaatgcagctcctcgccagcaacggaacaaagctggacagagaatgacgactttgacgagttgagagatgaaggcttcagatgatcaaacttctctgagctaaaggaagaagtttgaacccatcgcaaagcagctaaaaaccttgaaaaaagattagacgaatggctaactagaataaccagtgtagagaagtccttaaatgacctgattgagctgaaaaccacggcacaagaactatgtgacaaatgcacaagcttcagaagcctatttgatcaactgaaagaaaaggtatcagagactggagatcaaatgaatgaaatgaagcaacaaaagaagtttagagaaaaaagagcaaaaagaagcaaacaaagcctccaagaaatatgggactatgtgaaaagaccaaatctacgtctgattggtgtacctgaaagtgacggggagaatggaaccaacctggaaaacactctgcggatattatccaggagaacttccccaacctagtgaggcagaccaacattcaaattcaggaaatagagaacgccacaaagatactcctcgagaagagcaactccaagacacataattgtcacattcaccaaggttgaaatggaggaaaaaatgttaagagcacccagagagaaaggtcgggttacccacaaagggaagcccatcagactaacagcggatctctcggcagacactccgcaagccagaagagagtgggggccgatattcaacattcttaaagaaaagaattttcaacccagaatttcatatccagccaaactacgcttcataagtgaaggagaaataaaatcctttacagacaagcaaatgctgagagattttgtcaccaccaggcctgccctaaaagagctcctgaaggaagcactaaacgcggaaaggaacaactggtagcagccactgcaaaaacatgccaaattgtaaagaccatcaatgctaggaagaaactgcattaactaacgagcaaaataaccagctaacatcataatgacaggatcaaattcacatataacaatattaaccttaaatgtaaatgggctaaatgctccaattaaaagacacagactggcaaattggataaacagtgaagatccatcagtgtgctgtattcaggagacccatctgatgtgcagagacacacataggctcaaaacaaagggatggaggaagatctaccaagcaaatggaaaacaaaacaaaacaaaaaggggttgcaatcctagtctctcatgaaacagactttaaaccaacaaagatgaaaagagacaaagttggccattacataatggtgaagggatcaattcaacaagaagagctaactaacctaaatatatatgcacccagtacaggagcacccagactcataaagcaagtccttagagacctacaaagagacttagactcccacacaataataatgggagactttaacaccccactgtcaacattagacagatcaacgagacagaaagttaaaaaggatatccaggaattgaactcagctctgcacctagaggacctaatagacatctacagaactctccacccaaaatcaacagaatatacattcttcccagcaccacttcgtacttactccaaaattgaccacatagttggaagtaaagcactcctcagcaaatgtataagaacagaaattataacaaactgtctctcagaccacagtgcactcaaactagaactcaggattaagaaactcactcaaaaccactcaactacatggaaactgcacaacgtgctcctgaatgactactgggtacataacgaaatgaaggctgaaataaagatgttctttgaaaccaacgagaacaaagacacaacatgccagaatctctgggacacattcaaagcagtgtgtagagggaaatttatcgcactaaatgcccacaagagaaagcaggaaagatctaaaattgacaccctaacatcacaattaaaagaactagataagcaagagcgaacacattcaaaagctagcagaaggcaagaaataactaagatcagagcagaactgaagaagacagagacacaaaaaacccttcaaaaaatcaatgaatccacgagctggttttttgaaaggatcaacaaattgatagaccactagcaagacctaataagaaaagagagaagaatcagatagacacaataaaaaatgataaaggggatatcaccaccggtcccacagaaatgcaaactaccatcagagaatactataaacacctctacgcaaataaactagaaaatctagaagaaatggataaattcctggacacatacacccttccaagactaaaccaggaagaagttgaatgcctgaatagaccaataacaggctctgaaattgaggcaataattaatagcctaccaaccaaagaaagtccatgaccagaaggattcacagctgaattctaccagaggtacaaggaggagctggtaccattccttctgaaactattccaatcaacagaaaaagagggaatcctccttaacttattttatgagaccagtatcatcctgataccaaagcctggcagagacacacaaaaaaagacaattttagaccaatatccctgatgaacattgattcaaaaatcctcagtaaaatactggcaaaccgaatgcagcagcccatcaaaaagcttatccaccatgatcaagtgggcttcatcccggggatgcaaggcaggttcaacatacgcaaatcaataaatgtaatccagcatataaacggaaccaaagacaaaaaccacatgattatcttaatagatgcagaaaagacctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactcgcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtatatttagaaaaccccatcgtctcaccccaaaatctccttaagctgataagcaacttcagcaaagtctcaagatacaaaatcaatgtgcaaaaatcacaagcattcttatacaccaataacagacaaacagagagccaaatcatgagtgaactcccattcacagttgcttcaaaaagaataaaatacctgggaatccaacttacaagggatgtgaaggacctcttcaaggagaactacaaaccactgctcaatgaaataaaagaggacacaaacaaatggaagaacattccatcctcgtggataggaagaatcaatattgggaaaatggccatactgcccaaggtaatttatagattcagtgccatccccatcaagctaccaatgactttcttcacagaattggaaaaaaattctttaaagttcctatggaaccaaaaaagagccacattgccaagacaatcttaagccaaaagaacaaagctggaagcatcacactatttgactttaaactatactacaaggctacagtaaccaaaacagcatggtactggtaccaaaacagagatacagaccaatggaacagaacagagccgtcagaaataataccacacatctacaaccatctgatctttggcaaacctgacaaaaacaagcaatggggaaaggattccctatttaataaatggtgctgggaaaactggctagccatatgtagaaagctgaaactggatcccttccttacaccttatacaccaattaattcaagatggattaaagacttaaatgttagacctaaaaccataaaaaccctagaagaaaacctaggcaataccattcaggacataggcatgggcaaggactccatgactaaaacacccaaagcaatggcaacaaaagccaaaattgacaaatggggtctaattaaactaaagagcttctgcacagcaaaagaaactaccatcagagtgaacaggcaacctacagaatgggagaacatttttgcaatctactcatctgaaaaagggctaatatccagaatctacaaagaactcaaacaaatttacaggaaaaaacaaccccatcaaaaagtgggcgaaggatatgaatagacactttgcaggggaagacatttatgcagtcaacagacacatgaaaaattgctcatcatcactggccatcagagaaatgcaaatcaaaaccacaatgagataccatgtcacaccagttagaatggcgatcattaaaaagtcaggaaacaacaggtgctggagaggatgtggagaaacaggaacacttttacagtgttggtgggactaaactggttcaaccattgtggaagacagtgtggcgattcctcaaggatctagaactagaaataccatttgacccagccatcccattactgggtatataccgaaaggattatgaatcatgctgctgtaaagacacatgcacatgtacgtttattgtggcactattcacagtagcaaagacttggaaccaacccaaatgtccaacaatgatagactggattaagaaaatgtggcacatatacaccatggaatactatgtagccataaaaaaggatgagttcatgtcctttgtagggacatgggtgaagctggaaaccatcattctcagcaaactatcgcaaggacaaaaaaccaaacaccacatgttctcactcataggtgagaattggaaaatgagaacacttggacacaggaaggggaacatcacataccagggcctgtgctagggtgcggggagaggggagggatagcattatgagatatacctaatgtaaatgacggtgaatgggtgcagcacaccaatgtggcacatgtatacatatgtaacaaacctgcacgttgtgtacgtgtaccctagaacttaaagtataataataaaa

SEQ ID NO: 14765 - DNA, 530 bp, Homo sapiens; identical to SEQ ID NO: 14763

SEQ ID NO: 14766 - DNA, 9732 bp, Homo sapiens
gattccatggcaatccctgagcctgcagatcctggtgacagccaccaggaacctcaggatggaccagtcagcttcaaacctggtgtgttgctttccggaaggggaaggcaggcaggctggtggggcccatgtagccagctggccctttttcctgtgatacagcagtgccatttcagggaaaccttgcctccagaatcagcaaggcctgctctgtggcctgtaccacctcccaccttgaaggccaggctcacagggcccccagcggcctactggccaagcacacacacccttttccttcaccccatcttctgggaaggactggttcatctggcactttccttgccccgctgaaccacacaagcccttgtgcctggaaaaagcattctcaccctttcccacagccctaaccagagccaggaagtcatgctgtccttggtcttggagtcagcacaggaaacccaccaagagacaccatttgcagcagggccctttaaggctgggcccaagattgagaaagtaaatgagtttcattatgtggtgaagtatttattgacaagggctgccaagaatgaagttgtgaggccatgtgcatgtgctgaggaggggagtgtaccatgattgattagtcatgtctgctgtaggtgtaggaggcagggtgagggctcacttgctatgcatttgccctccaggggtttaaggcttctaagctcctgctcagaggacatcagcagctaacttccctgctctcagccttcaactctccttctctgaaccttgtgatcttcccaggcctggtgagttagcccttgacatttatgtctgctgtgtatttaggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacggtgagtggcaggctctaggggctgaggaagagcctggtcacattgaggggaggaggggaggaccccgctggtcccagcctgggaggagtgtctgctcctgcagggcttgtgtcacaccacatgtctgttgcagagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccagggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggtgagttcctgggctggggagactggacgagcctaggaggccagggccggctgccggcagctcttctgcctccaagagggccaggaagaaagagaacaggatggccatccgtcacccctactaggtccaccttccccttggcccacctgcttctcaggggtgtgggtctctcaagctacctggcttatggggagacagaagtcacaagaaccacctgctagtgccagagcccgtgagcggcatagcctggaggccacaggcacaatagtgccgcctactgctcctgctacagagagggcatcgcctcctgccctgccagggcagccttcaagtccccccatctcatctcttcacctcacccccttcattcccatgtgcgtttaagccactgtatctaggaagaatgtggatagggactgtggccacttgcagccccacttagttctgtttcattttccatgattttagttttttttttgttttttttttctttttcttttctttttttttttttttttaagatgggtctcactttgtcgtccaggcttgagtacagtggtgggatcatggctcactgcagcctagacctctccaggctcagctgatcctcccacttcagcctccagagtagctaggacttacaggcatgtgtcaccatgcctagctaatttttgtactttttgtagagacagggtcttgctatggtgcccaggctggtctcaaattcctgggatcaagtaatctgcccacctcagcctcctaaagtgttaggattacaggtgtgagccatgtgcccagccttgatttcagtttcttgcatcaaccacgatcagaaaataggtgagtacagtacaataagattttgagagagggagacaccacattcatataacttttattacagtatactgttataattgctttatattttattattattgtcaatctcttactgtgcctaatttacaagttaaactttggcataggtatgtacatagaggaaaataaatagtatatatagggtttggtactgtctgagatttcaggcacctgctaaggtcttggaacacacctcagtggactgtacagggaaagccgtgggccctgaaaggagctcattccctctgcaaatacagttaacctgtctcatcgctctgtgctagtccccttcctgggctttaccacaatggcccatcccaacaggtcaatgacacactcatcagcacttccatcttacctgaaactgaggcgcaaacacaagtttcctgcttgcacagctagtgagcagcagaggagcgctgtctttagggtgccggttcttcacctccagaaggccctccatggctggtccctgcagggccctgggcctgggagctggctttgaggctgaaggcatgtgcaaccaagcttcccatcccctccctgagtgtggtcccgggagggggacaactaggctctgtgtctcaagtgactctctctgccagaggctggccttggagctgtggcctctccccacccagacacagggctaagtacaaggccaccatcttggccatgtgcagcctggcgtgtggcaagtccaaggccttgttgaaggtcccgtcccaggcagcccctgccccagctgaccctccctatggcccaagaggcaatgtggagcagtgggaagcacccaggctctggcatcacttgtctgtttcttcctcagtaaaatggcagaatccctacccatgtcaaagttttgttatgaagactgctgcgtttaccaaatacctagcacgaggcttacctcatgtaggaacgcagtcaacgttttcccatttccccagcattttcagggttcaggttgtgtccaccgacactgacacttctctcttgtttcctctcgtgcgtggtgcaaggcttcaatatgctgatgactttcagaatttgccccacggtttggaaatgtgtttaccacgacgatatttatttcaaaaaaatgttgttcttaaaaacaaatttccaggccgggcgcagtggctcatgcctataatcccagcagtttgggaggccgaggcgggtggatcacttgaggtcaggagttcaagaccagcctggccaacatggtgaaaccccatctctactaaaaatacaaaattagccgggtgtggtggcgggcgcctaatcccagctactcgggaggctgagacaggagaatcacttgaacccgggaggcagaggctgcagtgagccgagattgcgccactgcactccagcctgggcaagaagagcgaaactgtcaaaaaaaaaaaaaaaattagcccggtgtggtggcaggcacctgtaatcccaactacctggaaggctgaggcaggagaatcgcttgaacctgggaggcagaggttgctgtgagccaagatagctccattgcactccagcctgggcggcagagtaggactctgtctcaaacacacacacacacacacacacacacaaacacacacacacacacacacacacacacacaccccaaatttccctttatttgtttgtaggaaggctgtagggcttgaatgtgtgccctgcagggaagcacactctgagtttgcacagcccttcccgcatcttagggcctgtcaggcgcaaggctgggttggggtgggggtctctctctgcggcggaactccctgcgcaggcgcccggacggaacggccggaacgagggcctagcaccggtagagggcgctgcgggccggccttccttcggctaggcaagagaaccacctgcagggtgttaggggaattgcagaggcagccgccggcctctgacttgggcacaatcttttttttttttttttttttttttttttttttgagacggagtctcgccctttcgctcaggggggagtgcaatggcacgatctcggctcactgcaacctccgccttccgggttcaaacgattctcctgcctcagcctcccgagtagctaggattacaggcgcctgccaccatgcccagctaatttttgtagttttagtagagacgggatttcaccatgttggccaggctggtctctatctcctgacctcgtgatccgcccacctcggccttccaaagtgctgggattacaggcgtgagccatttgcgcccggcatttttttttttttttttttttgacggagtttcactctcgttgcccaggctggagtgcaacggcgtgatctcggctcacggcaacctccgcctcccgggtgcaagcgattctcatgcctcagcctcccaagtagctgggattacaggtatgccccaccacgcctggctaattttgtatttttagtagagatgggatttctccatgttggtcacgctggtctcgaattcccgacttcaggtgatccgcccgccttggcctcccaaagtgctgggattacaggcgtgagccactgcgcccggctgatttgacacaatctgaacacaaatgagaaagctattctcagctgtctaattctcagaaaatcttccagaactagagaaaagcaacatttttttattcacaaaggcttgctggattgggagtcaaagagctgaggcttgagttccgggacccaagtcagtaattgctcagcaaactgctcctctgaaggctttggttttatcacctaagaaatggggaccttgttttaaacccctacagagggagcaagttgaggaaccccatggtggacatgacctcgttggtgccaaggccagtgtcacagccaggacccaagtaggacttacctttcctgtgccatctcatgaccctgtccccagctgcccaaccatgctgtccaggcagcaggactggcttcttcctggctgtttgtacaccctccacacatggcagcttcctctgcttctgtgcccgtgcatgggcctggcaccagtgttctgtcagtgttcctgtcctaaggctggccaaagtggtccctgcagagaaccagaagtctagagattcaaggtctgttcccaggaggcttggtaatttactagttgtgtggtctggagcaataagctttttctttctgggcctcaatttacccatatgtaagatgaccagcttggccagtaacagtggctcacacctgtaatcccagcactttgcggggttgaggtgggaggaccgcttgagctcaggagtttgagaccagcctgggcaacagagcaagactctgtctctacaaaaaataaaaaattagccaggcatgatggcgtatgcctgtagacccagctactcaggtggctgaggtgggaggattgcttgagcccaggaagttgaggctgcagtgagccatgatcgccaatgcactccagtctgggcaacaagagaccctttatcaactaaaaaaaagaagaccagcttgaaggggcttctcttccctggctccacctgctctttccttctttctccaaggttctgtcttcaacatccaggaggatccagccttcatggctctgcagataccttcccagtgttagcattattattaccttgaggatggatattttctccctctcccctgagtatctcaagattcctagcaagtggtggtcgtctgggagtcagagacccgtgttcctgtcccagcctgccatttacaaaccatgtagccttgggcagccggtgaaggattcaacctgttttgtcaatcagggatactgtctctcaaggaagttggaaggaaaagggatcaaacgagaaagtgctttgtggctgggcatggtggctcacctgcaagcccaacattttgggaagctgaggctggaggatcacttgagcccaggagctccagatcagcctgggcaacatagtaagactccatctctacgttaaaaaaaaaaaagggctgcagtgagtcatgaccactgctgcactccagcctgggagacagagtgagtccctgtctaaaaaaaaaatgaaagtattttgttaaaatgtacaccagctcagacaacagacttgcattttccttcctctctattagtgaaaaacagaattggccatctagcttttctcctgcaataacactgctgttgggaatatctaggttatctagaaatagtgacctatttccattgctaataaggtgaggacggtaggtctcagggtttaatttcccacccaatggtgtaagggatgaatcactaagcactgtcctgttatgtttcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaa

SEQ ID NO: 14767 - DNA, 2195 bp, Homo sapiens
ttttttctttgttgactagaacctctcgtccctcttgactttcatgggcatccttctgatatttatcatttaatgtaatatttcccttaggctcctcatatgttatcaaataagatttttcctgtctatttccagttggtcaagagctttattttcgttgtcggttgctgtttgtttaccttaggtggaaattagattttcaagtactttggcctttgatactaggtatcaataaagatggtaatatatatgttctctatttatctgttaatgtggtaaatatgttaccttaataggtatctttaaatttacctgtcttacattcctggattaaatcttatttggtcatatttttaactattcagctggatttatcaagattttatttggaaaatttgtacctatatttataaataaggttctgtagttttttcctgatgtcttttttcattttttggtatcagagttattctgtccccatttttcctaaatataaagcttgatgttctactctttattgattttacattctctctgagtaatatctggtcttaccacttcaattatatgtctccttataccattttatcacctaatattctgtcagaggaccctatgtaggcagctatggttgatatttcaaatgttttcagaagacacagaagaaggagaaagaagaaatatgtggataaaaccagtgttttctattcataacttatgtaacatatatagctgactatgtttatggtgtctatcataaaaatgtataaagatagtcttttgatatattaagttgtatattctgagaaagtccttttttgtgtatgtgtatatttatgtatatatgtagtctgtatatgttttcaatacccatagcccttttcccactgaactggacggaaccttattgccattacaatgttttttcagagaagagtgttaatgcaataaagaaaagttaagtttcttttttctgagttctaagtaggctcctgaaacttctagttggcttaataatcttgacacacaagatagtgtatttcaagcagctgagctatatgaaatagaaaagggttttgagtttttaaaataaagctctgaagatatcagtgcataaatttatttttattttaacttttaacaacagattggaaagaaattagccaaagagtgagatgatctcatcacattattaaataagtgttgccttggttagaaggggagttgaaacaaggttcaggagacatggcagccctgtgttctgcctttctttcctctacagcctgagaccagggataatgatagaagctccctttagttgaagatttgagcattggagatttgtgcttcactctccaggtgaaagccaggggatggcaagcgttatctaaggcccctgtctgatgatagtgtgctggtggcagagttggaatggctgcacagcctgcttcttctggaattttgtgaagcaacaatgtcatgggtgtgtcccatattgaatgacatggtatcacttagatggagatggttaactatatgagagaagtctgtagataaagcaggtagaagatagttagcaggctcctatgggcccaggaaggcagttgagacttcatgcacttttgggcagaacaagggagctggatgcaagaccagtgctttaaaggacctcacagtaatgttgagaagaagccaggaatggtagtatggaatacatgattagagtctactaagactacagatagttcactgaaaacccgatcacacaaatgctgtgactagagacttgacaggtgccaaatcagagtgctacaggtccaatgcctctcaccgataccatgcggctgctgtgtgaacttccctcaccacgtaaccctcaccttagggaagagaaggatgagaagtcatgaattcttaagatgagcatatgcagaaattactgaggaaaatcagaatgatgtaagcttatctagaaatgactagattatgttttctgatacttggtgctacagaagcatgagagagaggaggtaagttctattgcagaaaacagtatgaccaggcacagtggctcatgcctataatctcagtactttagaaggttgaggcacaatgattactcaaggccaggagttttagatcagcctggtcaacacagtgataccccatctctatcaaaaaaaaaaaaaaaaaaa

SEQ ID NO: 14768 - DNA, 353 bp, Homo sapiens
ctgggcgtggtggcacgcgtctgtaatctcagctactcgagaggctgaggcaggagaatcgcttgaacccaggaggcggaggttgcggtgagcagagattgcgccactgcactccagcctgggtgacagagcaagactccgtctcaaaaataaataaataaataaataaaataaaaatgctcccctcattcattttgatttaatgggttggtatagaatgcaagatatttttcccagtgtacacgcaatagcgaattgagcaaaaaatgtattaagtaagctttttactttcacatcaaaatcaataccagcctgttgttgaaaattttaagattatgatttcttcatcaatt

SEQ ID NO: 14769 - DNA, 1839 bp, Homo sapiens
aatgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaacttacattgtgcccttgattattgaaaacttcctttttataacagattcactgtttggaagctaaagtaaaaatgagccatgttaccagaagtaataatttctatcttattactgatgtttttatactttgtggtaaaactatggaaagttaggttttcagatgctgtggtagctgaaagagtttgatgtacatgtggttaaagtgtgaagaaaatatgaaggaaaaagtatgaaaagtaccctagtcattacctaattgctattttgtttttaaggatctaagaagtgttattgcattgtaca

SEQ ID NO: 14770 - DNA, 1840 bp, Homo sapiens
aatgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattatatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaacttacattgtgcccttgattattgaaaacttcctttttataacagattcactgtttggaagctaaagtaaaaatgagccatgttaccagaagtaataatttctatcttattactgatgtttttatactttgtggtaaaactatggaaagttaggttttcagatgctgtggtagctgaaagagtttgatgtacatgtggttaaagtgtgaagaaaatatgaaggaaaaagtatgaaaagtaccctagtcattacctaattgctattttgtttttaaggatctaagaagtgttattgcattgtaca

SEQ ID NO: 14771 - DNA, 368 bp, Homo sapiens
taagacaaaaagatcgtttttattcacttttgattacaaaaaaaggttacatgaataaaataacaatttcctttaagagagggattcctgaatgattaaactgccaaggaaaaaagagtgaattcttccttttaataaaggtgacctaggtcctgaggaagttaggaaaaaagaaaaactcacattatacttgttaaatttgttttcaaatgtgattattaagttgttgtatttattttttgttatagacaaagcaaacccaaaaactagtctaaaaaagaattcctatgcattattaaaagagatagtaataaaatatgtattggtggtgaagaattccacaagcactcaagattgacataaccttt

SEQ ID NO: 14772 - DNA, 212 bp, Homo sapiens
ttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgat

SEQ ID NO: 14773 - DNA, 368 bp, Homo sapiens; identical to SEQ ID NO: 14771

SEQ ID NO: 14774 - DNA, 215 bp, Homo sapiens
ttgttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgat

SEQ ID NO: 14775 - DNA, 1969 bp, Homo sapiens
tcagattatgattaaattagatattaaacacttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaattttatctgtgtttcccatggaagaaactgaggctgggagatgttcattgtttgttatccaaggtcatatagctagtaagtagaagagtccagatgcaaacccaggccacctgaacaatgttcacatcattttaccatggagaagagattagtgcttttatttgtctaacactctggtcagtgaaattaaagtatctccgtgtgaaacagcatgcaaaaggctttgtttctaatatttttaacaaatccctttagatcgttgggaattaaacaaatacctagggcagtgtggacttacctgaagtcttttgacattttatgaagttctgttaaacctagaaataaagtcaaataaattttttattgctttagagacatagttattggaagttatttatagtttaaatatgtagccataataattattcgtgactatatttcaagatagtttattcagcaagcacttactgagaacctaccatgtactgggcactgtgttcttaaaaggactaattgatgagctcagtctagtgggggagatgagtaaaccagcaattataatacagagtactacttgagtagaggtacgcatagggaaaaccctgtaatagagggagcactgtctgtgttacctaatgcagacttgaggtaattcgaaaaggcatgttaagccatgtgatgcttgagtacaatcttgaaagcatgttaatacttaacttggtaagaacattttaagcgaataacagcctatgcaaatacacagaggcatttgagaatgcggcacttagagggagctacaaatagattgacatggcaagagtatgcactgactgttaagggatggaaggagttgagaccagagagagagagacatgattaggattgtgaagagccttagatgacatgcttttaaaaagttagtactttttcctaaagataattgggagtcattggtgaattttaatagggaaatgcttgctatccatttatgtttgcaaagattacataatagtgtggaggatggaattggtggtgcaggatatgagattggaagcaagaataccagttagttacgatagtaaccatgtcataaatgctccacgtccaaactggtactgacattagagagaaaagaaagaaatttgagaaataattagaaggttgagatttaactagtcttggtgagagagagagatagtcttcagatgtggtttggacaaatgggtggatggcgatgctggtcaaagccaatacatggttgaaaaagccggtttctgtggctagagggtgttgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaaaaaaagaaaaaaaaaaaaagaa

SEQ ID NO: 14776 - DNA, 1973 bp, Homo sapiens
  misc_feature (737)..(737): n equals a,t,g, or c
tcagattatgattaaattagatattaaacgcttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaattttatctgtgtttcccatggaagaaactgaggctgggagatgttcattgtttgttatccaaggtcatatagctagtaagtagaagagtccaaatgcaaacccaggccacctgaacaatgttcacatcattttaccatggagaagagattagtgcttttatgtgtctatcactctggtcagtggaattaaagtatctccgtgtgaaacagcatgcaaagggctttgtttctaatatttttaacacatccctttagatcgttgggaattaaacaaatacctagggcagtgtggacttacctgaagtcttttgacattttatgaagttctgttaagcctagaaataaagtcaaggaaattttttattgctttagagagatagttattggacaggaagttatagtttaaataaagaagccatattcntagtagagacctcttttcaagttgggttatacgaggttctcttaagaggtttctcttctatggtagtgagaggctgtgttcttaaaaggactaattgatgagctcagtctagtgggggagatgagtaaaccagcaattataatacagagtactacttgagtagaggtacgcatagggaaaaccctgtaatagagggagcactgtctgtgttacctaatgcagacttgaggtaattcgaaaaggcatgttaagccatgtgatgcttgagtacaatcttgaaagcatgttaatacttaacttggtaagaacattttaagcgaataacagcctatgcaaatacacagaggcatttgagaatgcggcacttagagggagctacaaatagattgacatggcaagagtatgcactgactgttaagggatggaaggagttgagaccagagagagagagacatgattaggattgtgaagagccttagatgacatgcttttaaaaagttagtactttttcctaaagataattgggagtcattggtgaattttaatagggaaatgcttgctatccatttatgtttgcaaagattacataatagtgtggaggatggaattggtggtgcaggatatgagattggaagcaagaataccagttagttacgatagtaaccatgtcataaatgctccacgtccaaactggtactgacattagagagaaaagaaagaaatttgagaaataattagaaggttgagatttaactagtcttggtgagagagagagatagtcttcagatgtggtttggacaaatgggtggatggcgatgctggtcaaagccaatacatggttgaaaaagccggtttctgtggctagagggtgttgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaaaaaaagaaaaaaaaaaaagaa

SEQ ID NO: 14777 - DNA, 219 bp, Homo sapiens
ctttcagtaacttgttggcagtccatcccagaaatataccccatttatgtgacttggaagtgtcattaggaagaccgccatagcctctgctccttctgcctatacattgttgtaggtgaagacattttttgaagccttgcatgggcagctaggcttaagtcagcagggaaacgtctgcttcttaaccagtggttttaaccaaacatttttttcagtgaa

SEQ ID NO: 14778 - DNA, 1611 bp, Homo sapiens
cctgtaatcccagcactttgggaggccaaggcgggcggatcacctcatgcctgtaatcccagcattgggatgggaggctgaggtgggtggattgcttgagaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagctttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccaggaactgcctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatgatgtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctc
